United States Patent 9,592,283 (IMMUNOLOGICAL COMPOSITIONS CONTAINING ATTENUATED HISTOPHILUS SOMNI) - sequence listing, part 6

SEQ ID NO: 6 - DNA, 2263857 bp, Histophilus somni (TK 2336)
  misc_feature (424645)..(426798): n is a, c, g, or t
  misc_feature (513831)..(518270): n is a, c, g, or t
  misc_feature (630129)..(634420): n is a, c, g, or t
  misc_feature (672798)..(677037): n is a, c, g, or t
  misc_feature (986240)..(990294): n is a, c, g, or t
  misc_feature (1417803)..(1418723): n is a, c, g, or t
  misc_feature (1806547)..(1806553): n is a, c, g, or t
  misc_feature (1807512)..(1808461): n is a, c, g, or t
  misc_feature (1870894)..(1871083): n is a, c, g, or t
  misc_feature (1873214)..(1873863): n is a, c, g, or t
  misc_feature (1876628)..(1877379): n is a, c, g, or t
  misc_feature (1922624)..(1923311): n is a, c, g, or t
  misc_feature (2042426)..(2044712): n is a, c, g, or t
  misc_feature (2119064)..(2123222): n is a, c, g, or t
atcaaaaacaacgctcatcaaaaattaagaagcggaattctaatcttaaattcagcgttcgtcaaatcagaatagtcaaaatcgcagaataaagcttatttttccaatcaaaaagcacaagagcggctcggattatacgtttttttacaaaaatctcaagtaacctttttcagtttttttgttcttttaataaagatctttgagccagtttattgtagaattaccatcaatttacaccgcacttttagataaaacttccaactatttaatttgcaaagatggataaaatgagttcaacagtttctacgctatggcgagattgcttatcacaattacaagatcaagtatcttcaaatgactttacgacttggctacgaccattacaggacgatgtcagtgagagtaacatgatactttatgcaccaaattgtttcattaaaggatgggttgaaaatcattatctcactcaaatcacaaagcttgctcagcaattgttgaataatgatcaattcatggtaaagatacaagacggcataaaacctactgagaaaacaacaacgaatgttgagcaaaagacacaaaatgaaaactgtcataatgaaataacttcgcaacaaaattaccgctcttatctcaataaaaatcatgtctttgataactttgttgaaggtaaatccaaccaattggcacgagcagttgcccagaaagtggctaaaaatccgggtgagcaaagtgctaatccattgtttttgtatggtggtacaggtctaggcaaaacgcacctgttgcatgctgtaggaaacggcattttagcaaataatcctcatgctcaagttgtttatatgcatgcagaacgttttatgcaatcttatgtaaaagccttaaaatccgatagaatggacagttttaagcgattttatcgtactgttgatgccttactgattgatgatattcaattttttgccggtaaagatggtacgcaagaagaatttttccatatattcaactcgttatttgagcgtggtcgccaaattattttgacttctgatcgttatccgaaggaaattgagaaaattgaagatcgtttaaaatctcgtttcggttggggaattagtgttgctattgaacctcccgaattggaaaccagagtcgcgattttgttgaagaaagcggaagaaaaaaatatggttttacccgaagaggttgccatgtttattgggggaaaattacgtactaatgtgcgagaattagaaggtgcattaaaccgtgttcatgcacatgcggaatttaccggaaaagcgattaccattgattttgtacgtgaaactctaaaagacatgttggcattgcaagataaattggtaacaattgaaaatattcaaaaaattgtggcggattattatcggatcaaaatttcggatttaaaatcaaaaagacgctcacgtaatataacccgaccacgtcaattagctatggcattagctaaagaactaacgaatcgcagtcttcctgaaattggtaggaatttcggtgatcgggatcatacgaccgttctgcatgcttgtaaggccatagcaaaactccgagaagaagataatggtatccaagaagattggtcaaatttaatccgcacactgtcagtataagggagcagactatgcaatttattgtttcaagagaacatctattaaaaccattacaacaagtttgtggtgtattaagtagtcgtccaaattttcctatattaaacaatgtattattgcaaattgaggggaatgttttacgtattaccggtacagatctcgaagtagaactttcaacacaagcacaacttattcaagcatcgcaagacggtagttatacgattccggcaaaaaaattcttagatatttgccgcagttttcccgatgaagcggaaattactgtaatttttgaagaagagcgtgcattggtgagatccggtcgaagtaaatttaatttaaccgctttacctgcagacgaatatcctaatttagctgattggcaatcagaggtggatttttacctgcctcaaagtacattacgtcgcctaattgaagcaacacaattctctatggcaaaccaagatgctcgttatttcctaaacggtatgaagtttgaaactgaaggcaatttactacgaacagttgctactgatggacatcgactcgccgtttgcacaattccgttagagcaggatttgcatacacatgcagtcattttgcctcgcaaaggaatattagagttaatgagattactggaaaacagcgaacacgctgctcacgttcaaattggcacaaataatttacgcattgatttaggaagtattatttttacatcaaaattaattgatggtcgtttcccagactatcgtagagttctcccaagaaatgcaactcatattatggaaggtaattgggaactgctgaaacaagcttttgctcgtatggcaattctgtctagcgataaagttaaaactgtccgtttgcaattgacctcaaatcaattaaagattacagcaacaaatccggaacaagaagtggctgaggaaattttagatgtcatatataatggggcagatatggaagttggctttaatgtaagttatattttagatgtacttaatgccctaaaatgccaacaggtgcgattatgttttactgatgcctcatcaagttgtttattagaggatgctgatgatgaaagtgcagagtatgtcgttatgccaatgcgtctataaacaatggcaatatcacgcttaatcatcaatcatttccgcaacttaacagccatagatctggaatttgaacgtggctttaactttattatcggcaacaatggaagcgggaaaacaagtttactggaagctattttttatttagggcacggacgctcatttaaaagtgcggttgcaaatagaataatttcttatcagcaaccgcactttattttacatggtaaaattcaagagcaacaacatcaatggtctgttggtttgcaaaaacaacgtcaaggtaacactttaatgaaaataaacggcgaggacgcaaaaaaaatttccgatcttgcccatttattgcccatgcaactcattacacctgaaggattaaccttattaaatggcggtcccagctatcgaagggcttatttagattgggggttatttcatcataacgcatcattttataatgcttggagtagcttaaatcgtttacttaaacaacgaaattctgccttacaacaagtttgttcttatgaaaaactcaaaatttgggatagagaattaaccaaacttgcttatcaagtgagctactggcgagaagcgtatgcggaagccttacgctcggaaatagaaaaaacctgtcagctttttctacctgaactagaaatttctgttagctttcatcaaggctgggataaaaatatggactatgcggatctgttacaacaaaactttgagcgagatcgtgctttgggttataccttttccggacctcaaaaagcagattttcgttttaaagcaaacggattgccggttgaagatattttatctcgtggacaattaaaattgttaatgtgtgcattacgtttggctcaaggtgagcatttaatgcaacaaaaaaaacgccactgtatttttctacttgacgatttcgcttcagaattggatcaatataaacgcacattgcttgctgaacgcttacaaaaaaatggttcgcaagtttttgttactgcaataactcgagaacaattacaacagatacaaccagaaaagcaccgcactttttaccttgaaaacggaagaataaaagatctttaaaataagcaaaaaataaacctgaccaattgtcaggcttcacatagcgttataaagatttatcttgtaccatacacaacaatagttttgccatgtgctgaaattaaatgctgatcttctaacattttcaaaatacgcccaacagtttctcgtgagcaacctaccatttgtcctatttcctgacgagtaattttaatttgcataccgtccggatgagtcattgcatcaggcatcttagctaaatttaacaaggtttgagcgatacgacctgtcacatctaaaaatgccaaattgcttacctgctttgaagtattttgtaaacgatgagctaattgaccggctaaatacattaaaatttctggattaacttgaattaattggcgaaattttttataagaaatttctgcaatttcacatgagcttttagctttaacccaagccgaacgaggctgtgtttcatcaaataaaccagcttcgccaaaaaaatcaccttgacttaaataagtcaaaatcatttctttaccttcctcatcttttaccatcacggcaacagaccctctaattaaataataaagggtttccgccttttctccagcatgaatgagggagctttttgctgagtatttatgaatgtgacaatgagataggaaccactctaacgtcggatccatcgatggtgctgattgtccttgttgttctaacataaaatctcctagtcattttccatttaaaaaatccattttatttttaatatcaatggattgatgtaactcagaccaaactagtatcgctttcccctgacgaatgtttttaaataaattttctcttttttcggctaatgaaagctcggtactaccataatccgtaccttcacgtaaaataaagctatccacaatatttaataaggtttgctcttctaatttttcccatggaataagcattgcaaattgctccaatcttacctaaaaatttctattatgcaaataaactttccagcagtttccattgttgctcaaaaccttgattaggcaagtgcctaaagttatttcttacgtaacgcataaactgtccttcgcataaagtaacaagatgggaagcaataattttttcatcaagatgaaaagattttccttctctcaatttacgcatttgtagaatattcacaaactgtaattctaaacgatcaaaaaatcgtgcaactcgtgcttgtaactgactatcttcaaacattaaagcatgccctgttaaaattcgggttaatcccggattttttcgtgcaaaatcaagaatagtttgcaaaatatctctcacacgattcatggtattggtttcgttcttgatagagtgattaattcgactaaataaagtattttctatattatccaataatgcttcaaacattttggttttactgggaaaataacggtaaagtgcggcttcagaaacaccgacttcctgtgccaagcgagctgtcgtcatacgctccattcctcgttctgaatgtaacatatgggttagtacggttaatacctgttgacgacgttcttttactgttcgtttctcaattttttgcgttttttgttttgaggcaacaacgatttcagcatcgccaatatccaattgctgttgttccattattttttgcctgaatgaccaaaaccaccattaccacgatctgtttgctgaaattcttctacaatattgaactcagcttgtactacaggtacaaacactaattgtgcgatacgatcaccaatttcgattttgaaaggtttatcacttcgattccaaagagaaaccatgagtggaccttgataatctgaatcgattaaaccaactaaattgcctaatacaatcccatttttatgtcccaatcctgaacgaggcaaaatcactgctgctaaattaggatctgcaatataaatagataaacctgttgaaataagttttgtttctcctggctggacttcaaatccctcgtcaaccaacgctcgtaaatccaatcctgccgatcctatggttgcataagttggtaatggaaactcagttccaatacgtggatctaaaatttttacatcaatctttttcatttactttcttccaatttccatttataacgcacaataattttatcaaccaattgtttagctaagtcacttttatgtttcaatgtcaacctctcttgcccattttgccaaaacagctgcaatgcgttttgctctgaattaaatacttgcccaccggaaacatcatttgcacaaatcatatccaaatttttacgttgtaatttgtctttcgcatactgctccacattttgtgtttcagccgcaaatcctacaacaaaaggacgattttccattaaattggctacagttgcaagaatgtctggatttttgaccaactttaagaccatttcatcattaccggggattttcttaattttttgttctgcaatttgttctacacgataatcagctaccgctgcacaaccaataaaaatctgattttgttccgcactttgtattgcatgttgatacatttcttgtgccgaaactacattaatgcgttgtacattatgaggtgtcgctaaattgacaggtccactgattaaagtgacttttgcacctcgttgagcaaaagcttcagcaatagcaaaccccattttgcctgagctatgattactaatatagcgtaccggatcaatggcttctcttgttggacctgcggtaatcacaacacttacatcaagtaaatcttgagtatgtaaaaaggattggcaaagtgcggtaaaaatttcaaaaggttctgacatttttccgatacctacatcaccacaagcctgttcaccactattcggtccgataaactgcacaccacgagccatgagttgtgctaaattttgttgagtaacagtttgtgcatacatttgttggttcattgccggagccagaaaaattggagaattcgttgctagacaaatagtggataataaatcgtttgccataccgaccgccatgcgtgcaataaagtctgcactggcaggtgcaattacgataagatccgcccacttagccaattcaatatgtcccattgccaattcagcttcatgatcaagtaaagattgtgatacagcgttgccggaaattgcttgtaaagttaaaggtgttacaaattctgtcgctgcatttgttagcactactcgaacttctgcttgtgctttacgcaataaacgaattaattctatggttttatatgcagcaataccgccggtaattccaatgacaattcgttttccccgaataagattttgcattgttagtccttaatcacaatccaaagtgcggtcattttactgcaatttttcataagaaaacatttaattttgcgattttgcacgcaaaataaaaaatacagtatttaaaacagcaacaaatctcttcatctttatcgttaaatattttttcctttgctaacaagaattttctatgacacaacaaaatacaactttaatgccgagagaaaaactactgaaatatggagcttcatcacttgatgataaggaattattagcgattttcttacgtacaggtataaaaaattgtcctgttatgcaactctccgagttggtacttgctcatttttcttctttaagaggattaattaatgcagaccaaaagcatttttgccaaatgaaaggattgggtattactcaatttgtacaattacaagcctgtactgaaatgaccaaacgttatctcttacaagaattacagtttgcacaagaatttaccagccctgatacggttcgtatgtatttacagactgaattggaaaataaagatagagaaatttttatggtactgtttttggataatcaacatcgtttaataaaaaaagaggaaatgtttttaggtaccattaaccaggcaaatgtttatcctcgtgagattattaaaaccgcactattttgtaatgcagccgcacttattcttgcacataatcatccttccggtgtttcaacgccaagcatggcagacagaaaaatgaccgagaatataaaacaactatcagaattaatggaaatccgtgttttagatcattttatcattggtaaaggtaactatttctccttcgcagaacaaggctggatctaggatcattcgatgaattattcaatctatttgcgtaaatttttatcatttttttcagtgaatttatctatttaggcttgagaataataaacaaaggtcgtataattcacgacctttaatatagtgggtcggctatgcgacctgacgaggtagccttcaaaatcttgaattttgaagtggtccgaaccctaagctcgagcttatatttttattggagattaatatgtctagagtctgtcaagtaacaggcaagcgtccagcagttggtaacaaccgttcgcacgcaatgaatgcgactcgtcgtcgttttcttcctaacttacacactcaccgtttttgggttgagagtgaaaaacgtttcgtaactttacgcttaacagcgaaaggtatgcgtattattgataaaaaaggcattgatgcagtgttggctgaaatccgtgctcgtggcgagaaaatctaaggagctaaaaaatggcagctaaaggtgctcgtgaaaaaattcgcttagtttcaacagctgaaacaggtcatttttatacaacgactaaaaataaacgcaatatgccggaaaaaatggagatcaaaaaatttgatccggttgtgcgtaagcatgttatttacaaagaagctaaaatcaaataatttagttttcacgataaaaaagcccgacatgttcgggttttttattttttcaaattttactttttgccataagatagctgaaagacttactcttggaaaaaaaacatgcctgaattacctgaagttgaaacaaccttaaagggcgtaagcccttatttaaaagggtttataattgaaaaaatagtagtacgtaatcccaaattacgctgggaagtaagtaaagaactcagcacatttaaacacgttaaaattcttaacttaactcgtcgagccaagtatctcattatccacacggaacaaggttacattatcggacatttaggtatgtccggttcagtccgcattgtgccgcatgacaatcctgtcaataagcatgatcatttcgatattgttatgaacaacggcaaattactacgctataacgatgctcgtcgctttggtgcttggctatggacgaataaccttagtgaatttcatctttttttcaagttggggccggaacctttatctgaaacgtttaattctacttatttgttcaaaaaatctcgtcaaaaaagcaccgcacttaaaactttcttgatggataattccgttgttgtaggggttggaaatatttatgcgaatgaaattttatttctatgtggacttcatccacaaaagatcgccaaaacattgacaaaaaaacagactgaacaacttgttttcactattaaacaagtgcttaacgaagctattgaacaaggaggaacaaccctaaaagattttttacaacctgacggtcgccccggatattttgctcaaaaacttttggtttatggaaataaggacaagccttgtccaaggtgcggtacaaagataaaaagtattattattgggcaaagaaatagctttttttgtccgcaatgtcaaaaaaagtgacattactttctttgttttttaaaaaaaatatgttaaacatcaataatgtctttttattttcacaatcagtaaacgcaaaaaggaatatgtaatgaatggagcaaatttggtcgtagaatgtttaaaagctcacggcgtaacttccttatttggctatcccggtggggcgataatgccagtttatgatgcaatttatgattctggtttagatcatctactttgtcgtaatgagcaaggtgcagcaatggcggctattggatatgcaagatcaacaaataaagtcggtgtttgtgttgcgacgtcgggaccgggggcaacaaatttaattaccggtttaggtgatgccttgatggattcaattcccattattgcaattaccggacaagttgcctcaaattttatcggtacagatgctttccaggaagctgatattcttgggttgtcacttgcctgtactaagcacagttttatcgttcaacatattgatgaattacctgaaatcattgcgaaagctttccaaattgcacaaagtggtcgtcctggtcctgtgcttattgatcttccaaaagatgtgcaatttgcacctacatccttaaaacccattgtttatcccaaaattgcggattctttacaaaatttagtcgcacttgagcaagcgaaaaatttactttctcaagcaaaacgccctgtgctttatgtaggtggcggtgttggaatggcaaaaagctcggatggtatgagtggcgtaaaagctatacgcacttttcttgatataacaaatattccatcagtatcaaccttaaaaggtttaggaacaatacctcccaaacatccactctatatgggaatgattggaatgcacggtacaaaagcggcaaattatgctgtgcaagaatgtgatttacttattgcttgtggggcaaggtttgatgatcgtgtaacgggaaaattagatacgtttgcaccacatgctaaagttattcatattgatattgatgttgctgaaattaacaaactccgtaaagcagatgttggactacaaggggatttggtggaggcggttactaaccttgcccaactattggatattgaaccgtggcgtaaagatattgagcagttaaaagcaagttttgattttaattatattgaaaatacagaagataaagagatagagccctgtgcattacttcacacattatccgaacgcaaagcaaaaaatgcggtgattacaactgatgtagggcaacatcaaatgtggtcggcacaacatatgaaacattatgaacctgaaaattatattacatctgcagggttcggttcgatgggcttcggtttgccggcagctatcggtgcggcaaaagctcgtccccaagatccagttattttaattactggtgatggctcattgatgatgaatattcaagaattgggttcgatcaagcgtggaaatttaccaatcaaaattttattgcttgataaccaacgtttgggtatggtgcgacagtggcaatcgctcttttttcatggtcgccatagccacactgttttagatgataatcctgattttgttactcttgcttctgcctttggtattgcaggtgaacgaattgaaaaggcaagtgaagtttccgatgctttggatcgattattaaatgccaaagaagcttatttactacatgtctgtatcccagatgaagaaaatgtatggccacttgtaccgccaaatacatgcaacagtaatatgattgaagaagatattggggtgtaaacaatgaaaacttacgatttaactattcaagcaaacaaacgccctgaaactttagagcgtttgttaagagttgtccgccatcgtggttttgaagtcattattctacatagtgaaagtaaaggtaatgttattgatttgagacttactgtgcaaagtgagcgagctattgaattattgattcaccaattagtgaaattaccggatgttattacattaagctaaagagcggtctaaatttgtataaattattatacaaaatagatggttagtttaaagggagataagttgtggaaggtgctgttttagcgattaaattgggattggttgaagagattgtttttgaaaatggttcaaagatgtcaacggcaattcggaaaaaaccgatggaacaagctatcgttcatgaattaggtgcggaaggaaatgatgttggactgaaagcacatcatggaggcattgataaagcactgttttttatggctgaaagatcttttgctaaattaaccgctcttttgggtaagcatgatagctatcaaggagaagctatctatggtgaaaattttattgtttctttttttgatgaagaaaatgtatgtgtcggcgatcagtaccagatcggagatgtacaaattgaaatttcacaacctcgcataccttgtgaaacgttgtcaaaaaatgccaataataaaaatactcgagcgattgttgtagaaacagggctgaccggttggtatgtgagagtcattaaaaatggcgtgatcaaaaaaggggataaaatccggcgtttagctaacccttacccaaaattaaccattaaatatttaaattatttgctggcaacggaagcgactgtggagcttaaaactcaattagaacaagcaattgaatgtcctgttttggcggaggcttttaagcgttacttaaaaatgaaatggcgaaaaatcagttaaatatttggttaagtgagatattattaatcggcttatgtgaagaataaagaacgtgattaaatatttactgatataatggcgaaaatttttcagataattttaacaagcggtctctaattttgaatatttctttatttcgacaaattctctcctctacaaaatggcagaatgatatttttactttatctccgcaaaaacaagattggttattacatcaaggttcattaacccgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccacaatctacgattgagaatgttgcacctgacattatcaatgtaggttcaacgcctattggcttatggcttttccctcaacaaccaaaaagaaaaacacttgaatggatatacgataccgcaacaggattatatgctcgtcgttcagtattgcttttaaatcaatatccaatcgaaattaaagaattgtttttgcaagattttaaattttttcaatcaaaggtctaaagcatgagaaccccgaaaaagacaaacaaaaaagcgaaaaaaatcaccgcacttacagaagatccgtattttttccaagagcaacagaaatatgctaatccaatcccgagtcgagagtttattttacaaattattcgtgattttaatgcacctatgtcgaaagaagatctgttcaagacattggctatcgttgatcctgaacaaaaagagggaatgcgtcgccgtttgcgtgcaatggaaaatgaagggcaattggtctttactaaaagaaagtgttacgccttgcctgaaaaattggatttattaaaggggtcagtgattggtcatcgtgaaggctatggttttttacaaatcgaaggaagcaagtcagattggtttattccaaatattcaaatgcaaaaagttatccatggtgattttgtattggcacaacctaatggctatgaccgtaaaggacgttcagaggtgcgtattgttcgagtgttagaaagtcgcaataaacatattgttgggcgttttttcatggaggaggggattggttatgtcgtgccggatgatagccgtattaatcgtgacattctgattccgaatgagtttcgcaacggagcgagaatgggacaggtagttgtggttgaacttaaacctcgtacagcaacatttacgcagttggttggaaaaattgtagaaattcttggggagaatatggcaaagggaatggaaactgaaattgctattcgcaatcatgatattcctcatatttttccaagtgcggtagaaaaacaagtaagaaaatatacggatagtgtgccggaggaagcaaaacaaggacgaagagatttaagaaccttaccattggtaaccattgatggtgaagatgcacgagattttgatgatgcggttttttgtcaaagaagtggtgatggcgggtggacattatgggttgccattgccgacgtgagctattacgtacgtttgcgtactgcattagataacgaagcatatcagcgtggcaattcggtttactttcctaaccgagttgtaccaatgttgccggagattttatcgaatggattatgttcgcttaatccacaggttgatcgtttgtgtatggtatgtgagatacgaatttcgccacagggaaaaatgactgattacagtttttatgaagcggtcatgaactcatatgcaagattaacttacactaaagttgcacaaattttggcaggtgatgaattattacaacaacgctatcatgttttagtaccgcacttacaagaattgcaccaaatgtatcaggctctgctgcaagctcgttatcagcgtggagccattgattttgaaactattgaaactaagtttgtcttcaatgaaatgggacgtattgaatgtattgaacctatggtgcgtaacgatgcccataaaatcattgaagaatgtatgattttagcaaatattgcagcagctaattttatggaacgtcatcaagaacccgctttatttcgtattcatgccggaccaagtcaagaaaaactcagtgcatttcgtgcttttctacgtgaatgtggcttaacgttaaaaggtggtataaaccccacaaccgcagattacgcacagttgttagcccaagttcgtgaacgtccggatcatgaattaattcaaactatgctacttcgttcacttagccaagctgtttatcaccctgataatattggacattttggtttagcactaacggaatatgcacattttacttcgcctattcgccgttatcctgatttaacgttacatcgtagtatcaaatatttattagcaaaacagcaaggttctaaaagaaaaacaaccgataccggcggttatcattattccctagaagaaatggatcttctcggtgatcattgttctttaaccgaacgccgagctgatgatgcaacaagagaagtggcagattggctaaaatgcgaatatatgcaagatcatgttggagatgaatttgacggtattatttcttccgtaaccggttttgggttgtttgtgcgtttagatgatttatttattgatgggctagttcatatttcaaccttagataatgattattatcaatttgactcaataaaacaacgtttaattggggaaaattccggtacgacttatcgtctcggtgataaagttaaaatccgtgttgaggcagtcagtttagctcaacgccaagtggattttgttttattatcgagtcagcgtaaacctagacgttccggcaaaacggcgaataagcgagcgaaacaaaaaagcttccaagaaaagaaccgcacttctaagatcgagcgacataaaagtgcggtaaaaataacaaaaaaattatcaaaaaaacaacaaagtccggcaagtaaaacaagaaaacagaaaaaacagaaaggataaaaaatcatggcagaaaatatttatggaattcatgcggtgcaggcttttcttattaatgcaccagaacgtttgatcgaagtttatgtgctaaaagggcgggaagataagcggttacaatccgtactgaatgagctttataaattaggtataagcgtacaatttttgaatcgtgatacattggataaaaaagcgaacggagaagtacatcaaggtatcattgctcgtgttcaaccagctaaagagttgaatgaaaatgacttggttgagatcttacaaaaaaaagcaaatccattattgctggtattggatggtatcacagatccgcataatttaggtgcttgtttacgatcagcagatgctgccggtgtttgtgctgtgattgtgccaaaagataaatcggcacaattgactgcgattgctcgtaaagtcgcttgtggagcggcggaagttgttcctcttgttcgtgtaacaaatttagcccgcactttacgagatctacagcaacaacataatatttgggttgtaggtacggctggcgaggcgattgaaactttatacgaagcgaaattaaccggcggtttagcacttgttatgggggctgagggagatggaatgcgtcgtttaacccgtgaaacttgcgatcaattgattagcattcctatggcgggttccgtatcttcattaaatgtttctgttgccacaggcatttgtctatttgaaattgtgcgacaaagattaggataatactttcttcatctaaaaaggttggatgtgatgtgaaatatatttattatgtaaattaaaaggactgaaccctgcagaatacagagtgcagtccttgaattaaatcagtccaatcagatcatattgtcaggaaatttttgctattttatacccttcttgtctagttttgcatacgtttgacagccaatgtttaagccattatcgcacgctaatctataatattgtttagctttagaaacatttctttgtacactctgtccgttttcatacatcacgccgagattgtgttgtgcatttgcatctccctgttcagccagttgtttgaataagggaaatgcgtcagaataattttgttgtttaataaattgtaaagcacgattaaatctttcggtatctgtttcggcaagtgtagattggacaataccgaaagagagtagggcggtaaggagggatttttttagattcatcagagctcctttgttgactgcttctcatggttcgtttaaaaaattagatatttaagttaattgcatcatcaataaagtattggtccatatcaaatgcaggtttcgcccctttatttttgcctactatttgagaaggcacaccagcgacagtagtgtattctgaaacgaattgtaacactacggagtttgcaccaattttagcgtaacgcccaatttcgatatttcctaacactttagctccggacccaatcatcacaccttctcgaattttaggatgacgatcgccgctttctttacccgttccccctaaagttacaccttgcaaaatagatacatcattttcaatgacagatgtttctcctatcacaatacctgtggcatgatcgaacataatgccacaaccgattcttgccgcgggatggatatctacatcaaaggcaacggatatttggttttgtaaatagatcgccaatgcttttcgtccttgttgccataaataatgggtaatacgataactttgcaatgcgtggaagcctttcaaataaagtaacggtgtagagtattgttctacggcaggatctcgatgacgcacggctcggatatcgcaagccgcactttcgataatttgcggttgattttgatgtgcttcttcaataatttctcgcaatgcaatagcgggcataattggattagctaatttgttcgcaagaatatagcttaatgcactgcctagattgttatgttttaagatagttgcatgaaagaaactggctagcattggttcattttcagcgagttttgctgcttcagcacgaataagactccatacttctattgacatgttactcccttttgcgttttcttcccaataaagtaatagccgcatcttcaggttttttaccacaaaatagtatttgatatacctgctcggtaatcggcatttctacaccctgttgctgggctaataaaaaggtttcttttgtattgtaaaaaccctctataaccggaccaagttcattgatagccgttgtacaatcaaaaccttgtcctaacattaatccaaaacgacggttacgagactggttatcggtacaagtaaggactaaatcccctaagccggatgttcccataaacgtattcggattcgcacctagagatatgcccaaacgactgatttcagcgattcctcgagtaattaatgctgtacgtgcattagcaccaaaccccataccatcagaaatccctgcagcaatagcaattacatttttaaccgcccctccaagttgtacaccaatcatatcttgattaacatagactcggaatttgctacaatgaattctttcttggaactctaaggcaaattgttcgttatttgaggctaatgtaatagctgtcggcatgccggcagccaattctttagcaaaggtaggtcctgataagactgctaaaggataaccatatcctacatgctcttcaacaacttcttgtaataagcgtcctgtatttcgctccagtcctttcgttgcccaagcgatacgttgatccgatcttaagtgcggtttaatttgcatgataacgtcgccaaaaacatgacttggtacaacaattaataactctctggagtgttgaatggcttgtgctaaattgtcttctacatataaagaatcaggaaagtgaatattaggtaaaaatgcttgattttttcgctcattacgtaagcgttgacaatgttgaggacgatgtccccataagtaggttggatagccattgcgagaaaaggcaatagctaaggcagttccataagcaccggcaccaattacggtgattggagttggagaaggactgttatcattcatattttttcttagaattttcggaattaatagaaatattagggtgttattacaacaccctgaaagattaatgaacttctttcttttctttttcttcagtttttgactcctcttgtgcttgttgacgttgcatatactcaacaaataaggcatcaaaattgaccggtgctagatttaaagccgggaaagtgccacgattcactaaactggaaattaattctcgtgcataagggaataacatatttgggcattgagatgttaggcaatgtgctaattgtacatcttctaaaccgcttatagcaaagatgcctgcctgttttacttcacagataaaagcaacatcttcactgccttccattgtagtttcaacagagatattcaggcaaacttcataaagatcttctgctaaatgcgttgtttctgtgcttaaattaaaatccagtttcggtttccattcttgttggaaaatgtgcggtagattaggtgcttcaaaagaaacatctttaacgtaaatacgttgaatttgtaaaacaacttctgttccttgttcttctgttactgcatcttgatttttttctgtcatttttcgatccttatttatgttttttgactaaaggtaaatttgccgcaatccagccactgataccatctttcagtgagtaaactcgactaaatccttgtttaactaataattctgctgatgcacctgcattcatacctgttgcacaaactagaattacaggggtatctttatgttgttcaatttttcctaaattttgatttttaatctctgttggcaatacgttgatactgttgataatatgaccacgttgaaattcatctattgtgcgtaaatcaataacaatagcctcttcattattaattaaacgagtcgcttcggcgttttctactgccgtaactttactggtaaatgattttaccgatgtataaattaacatgacaaatacggcaatccatgctattaccattaggctatgattttttgcaaactctgttgctaaagggagatattcttgcattttttctatttttcaaggttaaagttaaggttaaaaataaagggctaagtataaccgcactttcttcatctttcaaaatttttcaaagaaagtcctgcaaataaattgatctatattatagatagcttccctgtttattggtatattagccccaaatttcaaggaagtcttgataactttgttgaaatagggtttccgattttatcggaaacgatttttaagtagaaaaaataggaaaaaaaatgttttatattcaattcgctatcgttttagtgtgtattctgattggggcacgcattggtggtattggtttgggcgttatgggtggtttagggctttgtattctcgccttcggcttcgggttacaacctgctggattaccgattgatgtgatgtttatgattatggctgtagtttctgtcgctgctgcaatgcaggcagctggtggtttggattatatgatcaaaatcgcaaccaatattttacgcagaaatcctaaatatatcacttttgttgcacctgccgtaacttggttatttactttcttagccggtactggccatgtagcttattctgtattaccagttatcgcagaagtaagtcgtcacagcggtattcgtcctgagcgtccactttcaatggcagtaattgcatcgcaatttgctattgtagcaagtcctatcgctgccgctgtagtggctgttgtgaactatttagaaccacaaggaatcaacttgggtagcgtcttaatggttactattccgtcaactattttaggcatagcacttgcttgtgtttttgtcaataaaatggggaaagaattaaaagacgatccgaattatcaacgtttattacaaaatcctgagtatgtcaaagaaaacagcgtaagtaatattgctgaaattgaaataaaaccgactgcgaaattatcagtgggcttattcttattcggtgcattacttgttgttgtgatgggagcgtatccggagttacgtccatcattcaacgataaacctatgggtatggctcacactattgagatcgttatgttaaccgttggtgcattgattatcttaacctgtaaaccgaatggtaacgcaattacacaaggttccgtattccatgctggtatgcgtgcggtgattgcaatttttggtattgcttggttgggagatacattgatgcaaggtcatattgcaggcattaaagaaagtgtgaagttattagttgaaaccgcaccttgggcatttgcatttgcactgttcttactttctgttttggtaaacagtcaaggggcgactgtagcaactttatttccgctaggtattgcattaggtattgaacctgcgattttaatcggggtatttgtagcagtaaacggttatttctttattccaaactatggtccaattattgcttcaattgactttgatacaacaggcacaacaagaattggtaagtttatctttaatcacagctttatgcttccaggtttattaagtatggcatttagcttaggtttcgggttattgtttgcaagtattttactttagctttcactaaataatttataaaaacaccgcacttgctttaagaagtgcggtgttttttgagattttgattttttaaataccgaataaaacagcaatgaaaacggtcaagccgaaataattgttatttaaaaaagcgttaaagcaactctctctatctctatttttagtcaaacggcattggtaaacgaaaaataagccggcaatagccaatacaataaaatatctgttatttaattgtgataaataacccacggaaaagagaaaaatcagcgttattatttgtaataatgcaatgattttattgtcatattgagcaaataaaatcgccgttgatttcacgccaatacgcaaatcatcatcacgatctaccatggcatattgagtatcatatgcgactgtccaagataaatttgcaataaataataaccagcattctagaggcaatgcttcaatagtcgcaccataagccattggaatagaccagccaaaagccgcccctaagaaaaattgtggcaaatgtgtataacgtttcataaagggataaataaatgccaaaatgactgcaatcacagataaaccaatagtataaaggtttaaacaaaggactaataaaaaagaacaaaaaacgaggacgataaataaccattttgcttcacgaggtgttgctcgacctgttgaaagtgggcgtagtgaagttcgtttaacttttccgtcaatatggcgatctgcataatcattgatgacacaacctgctgaacgcattaaaaatacgccgaatataaaaattgctagaactgatagggtaggcatcgctttttcggcaagatataatgcccaaagcgttggccaaagtaaaagcaatgtgccgataggtttgtctaaacgcattaattgtccataagcaatcagcttatcttttgcaaatattgtcatttgattggctaaaccttgtaattcttaataaaagtgcggtgtattttactgtaaaatcctttttggaaaaagtgagtttaccctataaagaaacagtgttatattgcgaaatacttttattgttaaactatcataaaatgactacattcaaagaaatcaactctgaacaagcatgggaaatattaaataataagaatgctgtattagtagacattcgtgatttatcccattttatttacagtcgtccgaaaagtgcttttcatttaactcatcagcgttttagtgaattccaacagaaatatgaatacgaccaaccgattattgtgagttgttatcatggtgtgagcagccgcaatgtggcacaatttttagttgagcaaggctatgatgaagtttatagcttaattggaggtttcgccggttgggtacaagcgaatttaccggtggaaagtggatattaaataaaaggcagacgattcctgccttagttcagtccagctgcacaaacataaattaaaacactataaaaaatcaccgcacttagtagcaaaacatattttgccagctgactgttacgttgatttaatttaaatgaataacgagcaataatgcctaaaataaaaggataagcccaaaagaaaattgacatccatctcatttgaaaatcatccaaatttggatttttaatgaaattaggtgagattaagagagctaatggccaaagcaaaacaggtaggcaaaacccaacgagtgcccaagaaaatctactaaatccggttggcatgttttgttttttcatttttatcctcgataatatatacaagagaacaggaatatagcaaatgaaactattatttggtagtgaaagagagaattttattatttggtttcgtgattatatccgagctaagtatttgcttgaattgaccattcaaaactatattgatgaaaaatataatcggtcggtgcgtggtgtttttatcgaagaaaatcatccattattgacacagcttgaacaagagaaaatactttttctgcaggatccttttaacccttgttatcagcaggcagcttgggaagccggcgatacacattccattcagtacaaaaaaacatcatgggtggctatttggaaaatctcatcgaaatggttccaacaaggtaaaataactttatttattaccgcactttgcactctaatttacgttttacagaacttgggatttgagcaaggtattttctattttgctcattatccagcaaatccggcacaacaaacagaaatttggcgttatatttcgcatagtttagtgcatctctcgccactacattttttatttaatctaagttggttttggttatttggcggggcaattgaacgacagctgaatgcaaaaaaattactgttgctcttttttgtttcatctattttgaccggagtcgtgcaaaattatttctctgattatcgtttcttcgggttatctggtgtagtttatgcggtattgggttatgtatttattttagataaatttcattatgctaaatttgctttaccatcaggttttttcttgatgttaattatggggatcgccttaggttttattagtccgcttgtaggtatttatatgggcaacagtgctcatattagtggtttattatgtgggattttattaggcttatggcaagttaaaaaaagggagttttgagaactaaacgtaacatattgaaatcaatgaaatgtgtattgtcttatttctatgctctttcaaactcaagataaaatagatcgaaatttggaggatagagataaacgctgtcttgaagagaaatttattttgccattatggttattcttaattttcgcataaaatttgataatttcctttgactaattgacaatcaaaaggtaatattcacgccctatgcaaaaggtaaaactacccctaactgttgacccgattaaagatgcacagcgtagattggattatcaaggttgttatgtgtccaatcaagttactcgtttagcggagtcagtagtcaaagtgctcagcgatgtgcaggtaacattatcgtttttcgttgatccgcaaaaattgactgtaatgaaaggaagagcgagtgttgatgtggaattagaatgtcaacgttgtggttgtcctttcagtcaatcattggaatgtgagttttcttatagtccagtgtctgatttgggtaagatcaatgaattgccagagatttatgaaccgatagaattaaatgaattcggggaaatagatttaattggaacggttgaagatgaactgattgttgctcttccaattgttccgatgcattcatctgaacactgtgaagtgtccgtggctgaacaggtttttggcgaattgccggaagagctggcaaaaaaaccgaacccgttcgctgtattagctagtttaaagaaaaagtaaatttaggagtatagccaatggctgttcaacaaaataaaaaatctcgttcacgtcgtgatatgcgtcgttcacatgatgcgttaaccactgcagctgtatcggttgacaaaacaagcggagaaactcatttacgccaccatgtaaccgcagatggttattatcgtggtcgtaaagtgatcaataaataatcgttgattgtttaaggtaatcacttgagtcatctaactgttgtgttagatatgatgggcggggacatgagtccccgtattactatctgcgaattggtaaaagcgttgggtaagcatccaatgctgtctttgttgtttgctaataaccaacaaaattttcctctacgtcaacgttttccaatcgatagtcaaaattatttagccgtctgtcattgctctcatgtgattgaaaataatcagggtttagttcataccttagttcacatttttgtagaataccagctaggtttattttatctatatgcagctttgttaaatataggtattgaggaaaccaaagaatataaagaatataaagctattcgagatatggcattacaatcttcaaagaaaggttaaagaaaatcttgccggtttgaataaaattaagacgtaacttgatgagataattatgtacagtagaattttagcaaccggtagttatataccggctaatatcaggactaatgctgatttagaaaaaatggtagagacatctgatgaatggattactactcgttccggtataaaagagcgtcgtatcgccggtgaaaatgaaacagttgccacaatgggatttgaggccgctaaaaatgcacttcagttagccaatatttgccctaacgatatcgatttggttttggttgcgactaccagccactcctatgcttatccaagtgctgcatgccaaattcaaggtatgttggacattgatgatgcaatttctttcgatttggcggcagcttgcacggggtttatctatgctttaagtgttgcagatcaattcattaaaacaggtaaagtaaaaaaagctttagtgattggtgcagatattaattctcgtaagttagatgaaacggatcgtagcactgttattttatttggtgacggtgctggtgccgtgatcttggaaagcagcgatattgaagggattatttctactcatttacatgcttctttagataaaagtaacgccttaattcttcctcaaactcaacagggtgaagtacaatccggttatattcaaatgcaagggaatgcaacttttaaacttgcagtacgagaattatctaatgtagtagaagaaactttacgtgataatcacttagacaaagctgatttagattggttggtacctcatcaagcaaacttacgtattatcacggcaactgctgaaaaattgaatatgtctttagatcaagtggtaattactttagacaagtacggtaatacaagtgcggcgacagtacctgtggcattggatgaagctgtacgtgacgggcgtattaagcgtggtcaattattattattagaagcatttggtggcggttggacttggggttctgcgttggttcgtttctaaattttaacaaaaattgaatatacttatttagtaggaaataaaaatgaaaaaatttgcaatggttttccctggacaaggctcacaagcagtgggaatgctggctgaattggctacagaatatccgattgttgaagaaacttttcagcaagcttcctccgttttgggttatgatttatggcagttagtgcaacaaggtcctgcagaagaattgaataaaacgtggcaaacacaacccgcacttttagctgcttccgtggcaatttatcgtgtatggcaacaaaaatatccttacctaaaacctgaagtgatggcaggacatagtttaggtgaatattccgctttagtatgtgccggtgtaattgatttccaagatggaattaagttggtacaacttcgtggtaagttaatgcaacaagcagttccggaaggaacaggtgccatgtacgcaattataggtttagataatgaaagcattgttcaagcttgcaaagcgtctgaacaaggtgagattgtgtcagcggtaaactttaattcaccgggacaagtggtgattgcaggagcaaaagtcgcagtagaacgtgctgctgttgcttgtaaagaggcgggagcaaaacgtgcgttgccgttagcagtcagcgtgccttctcactgtgcattaatgaaaccagcagcagaagaattggcagtagcgttagaaaaaatgacgtttagcatcccacaaattccggttattaataatgttgatgtgaaagcagaaaatgaaaccactaagattcgtaccgcacttgtgcgtcagctttatagtcctgtacgttggactgaaatagttgagaatatggcaagagagggaattgaacttttatttgagatgggacctaataaggtgctcactggattaactagtcgtattgctaaagagttgaatgctaaagcagtcaatgatttatcttcattgaatacagtggaagaaagcttagattaatttatgacaacagaggctgatactaaacagcctattttattgaggagtagatgatgcaaggaaaaatagcattagtaacaggtgctacacgtgggattgggcgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccggcaagtcgtttgggacagcccaaagatattgcgaaagctgttgcatttttggcatcggaggatgcgtcatatattacaggtactacattacatgttaacggtggaatgtatttaccttagtagaaatagggatttcaggctagccaaagataaggcgtaatgttaaaatcctgacatgtggtaatgtagctattgaaacaatcgagttacgttggctgttgcattctacaggttaacataacgtatttatgtttgtgtactgagacagatatcattgtggtttgaccttgtaaaagtaaaaacagcttgaaacttcataaaaaatacatacactattatatcttatcgctaaccattaataggaaaaaagcaaaatgagcattgaagaacgtgtaaaaaaaatcattgttgaacaattaggcgttaaagaagatgatgttaagcctgaagcttcatttattgaagatttaggtgcagattctttggatacagttgaattagtaatggctttagaggaagaatttgatattgaaattccggatgaagaagctgagaaaattacaacagttcaatcagcaattgattatgttcaaaataatcaatagtaatgatacttgaaaattacacatgaaatcagtataatccgtattcacttatgaccctttgagagggtcatatttttgtgtggcacattgtgcttgtatgaaatggggagctgaaacggcgttattacccgcaaagaggaaattaaaaatggcaaaaaaagtccaagcatacgttaagttgcaagtcgcagcaggtatggctaacccatcaccacctgttggtcctgcattaggtcaacaaggtgtgaacatcatggaattctgtaaagcatttaatgctcgtactgagagtctagagaaaggtttaccgattcctgtcgttattactgtttatgcagaccgctcttttacatttgtgactaaaactccgccggcagcggtattattgaaaaaagctgctggaattaaatctggttctagtaaacctaacaaagataaagtaggtaaagtcactttagatcaaatccgtcaaattgctgaaactaaagcagccgatatgaccggtgcaacaattgaaactaaaatgaaatctattgaaggtacagcacgttcaatgggtttagtagtggagggttaatctaatggctaaacttactaagcgtatgaaagcaatcaaagccggtgttgattcaacaaaacaatatgaaatcaatgaagctattacggtgttgaaacaattcacttcaacaaaattcgttgaaagcgttgacgttgcagtcaatttaggtattgatgcacgtaaatcagatcaaaatgtacgtggtgcaaccgtgttaccacatggtacaggtcgttcagtacgtgttgctgtgtttactcaaggtgctaatgttgattcggctaaagcagctggtgctgatttagtagggatggaagatttagcagagcaaatcaaaaagggtgaaatgaactttgatgttgttattgcttcccctgatgcaatgcgtgttgttggtcaactaggtcaaattttagggcctagaggcttaatgccaaatcctaaagttggtaccgttacaccaaacgttgctgaagcggttaaaaatgctaagtccggtcaaatccgttaccgcaatgataaaaacggtattattcatactacaatcggtaaagcaaatttctctgctgaacaattaaaagaaaacttacaagcattattagctgccttgactaaggcgaagcctgcgacagcaaaaggtatctttattagaaaagtaagtgtttctactactcaaggtgcaggcgttgctgttgatcaaagtagcttataattaatatagccaaacctttacagaggcgtattttgtatatataatgcacgcctctattttgccttatggcataatttctggttggtgcttgacctctcaagccccgtccaagaccgtaggggaaagagtatttcttaataatcctacgtagatggtgatacagaataagaatttttcttgcttctgtgcaccttagcctcagagaagactgcaaaagtgcggtgtttttttgagaagttttataattccgatcaatcggagtgtattcaggagctaaaagccaatggcattaaatcttcaagacaaacaagcaattgttgctgaagtaaatgaagcagccaaaggtgccctatcggcagttattgcggattctcgtggtgttactgttgataaaatgactgagttacgtaaagcagctcgtgaagctggcgtttctatgcgtgttgtacgtaatactttattacgtcgtgcagtagaaggcacagattttgagtgcttaacagatacgtttgtaggtccaacacttatcgcattttctaatgagcatccaggtgcggctgcacgtttgttcaaggattttgctaaagctaacgataagtttgaaattaaaggtgcagcctttgaaggtaagatccaaaatgttgagttcttagcaacattaccgacttacgaagaagcaattgcacgtttaatgggtactatgaaagaagcagcggcaggcaaacttgctcgcactcttgcggcataccgcgacaaattacaagaagcggcttaattaaagcctttcttaactcgtttaatttatttactttaggaattgattgttatgtcattaactaacgaacaaatcattgaagcgattgcttcaaaaactgtcactgaaatcgtagaattaatttctgcaatggaagaaaaatttggtgtttctgctgcggcagcagcggtagcagtagctgctggtccagctgaagtagctgaagaaaaaaccgaattcgatgtggttttagctgaagctggtgctaataaagtagctgtaattaaagcagtacgtggtgcgactggtttaggcttaaaagaagctaaagacctagtagaatctgctccggctaacttaaaagaaggtatttctaaagcagaagctgaagcacttaagaaagaattagaagaagctggtgcgaaagtagaaatcaaataattttgattttttcaatcttctagttcagaaaagacttggtggacaccccaaggtcagaataataatcctaccttttcgtgctttttcgaaggtgggattattcttttttatgctgtcgaagagtttatttgtagatgatcgtaatttgggagaaaaactttacttttgtctgcagtgggttgagtgcggtttgttttaagccgcactttttcgtttcattcgcaacgagattttttattttaagaacgtttcataacttcaaaaaattcttcattggtttttgccatcattagcttatcaattaagaattccattgcctcaatttcacccattggattaagaattttacgtagaatccacattttttgtaattcatctggtgtagtcagaagatcttctttccttgtaccagaacgattgaagtcaatagcaggaaatacacgtttttctgcgattttacgggaaagatgcaactccatattcccagttcctttaaattcttcaaaaatcacttcgtccatttttgagccggtatccacaagtgcggtggcaataatggttaaactaccgccttcttcaacattacgggctgcaccaaagaagcgttttgggcgatgcaatgcattggcatctacaccccctgataagatttttccggaaggcggtgttaccgtattataagcacgagctaagcgagttatgctatctaataaaataaccacatcttttttatgttcaacggaacgttttgctttttcaatcaccatttctgcaacttgaacatggcgtgctgccggttcatcaaaggttgaagcaatgacttcgccttttactgagcgttgcatttctgttacttcttccggacgttcatcaatcaacaatacaattaattcacattccggatagttatgaataatactttgtgcaatattttgtaataacatggttttacctgcttttggcggagcgacaattaaaccacgttgtcctttaccgataggggaggctaaatctaaaatacgagcagtcaaatcttccgttgcaccatttccacgctccattctgaggcgtgaatttgcgtgtagtggagttaagttttcaaagagaattttactacgtgatacttctggtttatcgtcattgactcgatcaacttttagtaaggcaaagtaacgctctccttcttttggtggacgaatttttccttcaattttgtcgcccgtttgcaggttgaaacgacgaatctgacttggagaaacatatatgtcatcaggaccggctaagtaagaactatcggcagaacgtaagaaaccgaaaccatcaggtaaaatttctaatatacctcctccaaaaatgtcctctccacttttcgcatgttgttttaaaattgcaaaaataatgtcttgtttgcgtaaacgagctaaattttctaagcccatttgtttttcacctaattctacaagttcagaaacaggtttatttttaagttctgttaaatgcataataaataattgagaatgttataaaaatgaattgataaatgaattgaatgtaaatatgaaattgcgtgcaaatttatcattaaatctttaagttgtctagctatctaacttaaaaatcaataaatgtgcggacattttttgaggattttttccgttcatgttattatcacccaaattctttactgataatttttatgcaaaatagtcatctttcacaacaacgtttttctgatcttgctttacatcgtatcgtgcaacaagcgataaaagaaaaaggctttgagttttgtacacctattcaggcattgtctttacctatcaccttaaaagggcaagacatagctgggcaggctcaaaccggcacaggaaaaacgatcgcatttttaaccgctacatttcatcatttactacaaaaaaacaatataaattcctcagaacaaccgagagcgttaattttggcaccgactagagaattggttgtacaaattgcaaatgatgcgaattttctagttcaagcaacagggttgaaaacaggcttagcttatggtggtgagggctatgataaacaattaaaggtaattgatcggggtattgatattttaattggtactacagggcgtgtaattgattatgttaagcaaggaattattcgtttagattatattcaagtggtagtgttagatgaagcagatcgaatgtttgatttaggttttattagagatattcgttatttattacgtaaatgtccggtgcctcaacaacgtttaaccatgcttttttctgcaactttgtcttataaggttcgtgaacttgcttttgagcatatgaatgatccacagtatgtagaaattgaacccttacaaaaaacggggcatagaattagagaggagttattttacccttctaatcaagataaaatggcattgttgatgactttattagaagaagaatggccagagcgttgcattattttttctaatactaaacatcgttgtgaggaaatatggggatatttaagtgcggatggtcatcgagtaggattattgactggtgatgtaatgcagaaaaaacgcttatctttactcaaacaatttacggatggaaccttagatgttttggtggcgacagatgtggcagcacgagggttacatattccggatgtgactcatgtgtttaattatgatttacctgatgattgtgaggattatgtacatcgtattggaagaacagggcgagcgggtgaaagcggtatttcaatcagttttgcttgtgaagaatatgcgattaatctgcctgcaattgaagaatatattggtcacagtattcctgtcagtcaatatgatgcgaaagcattgatcgaagatttgccaacacctcatcggattaaacgaggtgcatttgatagccgttcaaatttacaacgtactgtaaagagattgaaaaaaacttattaatttaaccgctcttttatgggatctttgccaagataagcaaatatccctttaattaccggacgataacgttgtacactaatacggaattttcgactaggaaaagagagataaaaatgacaccttatttaattgctccatctatactttctgctaatttagcacgtcttggtgaagatgtagaaaatgtgctaaagagcggtgctgatgtaattcattttgatgtgatggataatcattatgtaccaaatttaacctttgggcctgcgatttgtaaggcattgcgtgattatggaattaaagcacctattgatgtacatttaatggttaaaccggtagatcgtattattcctgattttgctaaagccggtgctgattatattacatttcacccggaagccagtgaacatatcgatcgttctttgcaactgattcgggattgtggttgtaaggctggtcttgtttttaatccagcaacaccattgagttatttagattatgtattggataagattgatgtgattttgcttatgtctgtgaatcccggatttgggggacaagcttttattccaagcacattagaaaagttaaaacaggctcgtaaaattattgatgaaagtggcttggatattcgcttagaggtagacggtggagtaaaagtgaataatattgctgaaattgctcaagctggagccgatatgtttgtggcaggatctgcaatttttgatcagcctgattataaaaaagttattgatgaaatgcgtcagcaactttctacaataagagagaaggaaacaaaatgacacaatttaaattaattggttttgatttagatggtaccttagtaaacagtttgcctgatttagctttatcaattaactctgctttgaaagacgttaatttgccacaagcatcggaaaacttggtgatgacttggattggcaatggtgctgatgttttgagtcaacgtgcagtggattgggcttgtacacaagctgaaaaagagttaacggaagatgagtttaaatattttaaacgtcaatttggcttttattatggcgaaaatctttgtaatatcagtcgattatatccaaatgtgaaagaaaccttagaagcattaaaagcacaaggctacattttagcagtcgtgacgaataaaccaactaaacatgttcagcctattttaactgcttttgggatcgatcatttgtttagtgaaatgctggggggacaatctttaccggaaattaagcctcatccggcacctttctattatttatgtggcaagtttggtctgtatccgaaacaaattctttttgttggcgattcgcaaaatgatatttttgctgctcattctgcgggttgtgctgtggttgggttaacttatggttataactataatattccaattgcacaatcaaaacctgattggatctttgatgattttgctgatattttaaaaattacacaataaggataaaaaatgacaaaaccggttgtattaagtggtgttcagccctcaggtgaattaactattggtaactatttgggtgcgttgcgtcaatgggtaaacatgcaagatgagtatgagtgtttatattgtattgtagatttacatgcaattacagttcgccaagatccggacactttacgtaaagcaacgttagatgtattggctctttatttagcctgtggtattgatccggagaaaagtacgatttttattcaatctcatatacctgaacatacccaattggcatggattttaaattgctacacttactttggtgaaatgagccgaatgactcaatttaaggataaatcagcacgtcatgctgacaatatcaatgtaggtttatttacctatcctgttttaatggcggcagatattttactttatcaagcaaatcaagtacctgttggtgaagatcaacgtcaacatttagaaattacacgtgatattgcacaacgttttaatgctctttatggggaacattttattgtgccagaagcatttattccaaaagcaggtgcacgagtaatgtccttgttggaacctgagaagaaaatgtctaaatcggatgaaaatcgtaataatgtcattggtttgttagaagatcccaaagcagttgtgaagaaaattaagcgagctgtaacagactcagatgaaccgcctgttgtgcgttatgatgtaaaaaataaagcaggtgtatctaatttattagatattttatccggtgtaacaggaaaatctattgtccaattggaagctgaatttgaagggaaaatgtacggacacttgaaaagtgcggtggcagatgaggttgctactatgctgactacattacaagaacgtttctatcatttccgtaacaatgaagaattattaaataaaattgcggctgaaggtgcagaaaaagcccgtaagcgtgcaaaggaaaccttagataaagtttatcgtgcaatgggttttgttactccataaaaacgatttttcccctaagtatttaggggatctttattcttattgtaatacattttcgaaaaaaacagtatttgcagtagggtcacttaatgaaaatagtaagaactttccgaaaaaccgctgttattacaaacctcagaaatctgatacttcgtatagaataagagaaaaatcttctatggcaaaaaatagaaaagcaagcatttcccatgtgacattattagggtgttaaaatccaaggttgtgctaatgaaagagaataaatattagcgatgaaatgagattgttcttctttgggaacggggaagggaataaaggttaatagttcttggtgtaatttcaaaatttttgtaaaacagaccgctctttcgatctctgaaaaaaaatctgggtttaatgctttagccacatatcctctttttattctgcctagtgccatagctaaatgaatgagtaacatgtctacttgtttcgtttttaaatttactcgccattttttaccaagacgatttcggatattaagagtaattgtcataatatcttcatcaattaaatggcgttgaactaaaaaaatcagcctttgctgtattaacatgaatttcattccattacgaaaaggatagtttactttacctgaaataaacacaattaagtagtgcatagatcacaactttgtaggaaaataaacaaaattttacacgataggaattaagatgttaaacaaggaaattatcgcacgatatgaaggattaatttttgatatggatggcacagtaattgatactatgccttgtcataaacaagcttgggagcttgttggtgctgaaatgggctatgctttggatggagatgttatgtatcaattggggggagctccggtaagaactattgccaaagccataatggaaaaagcacaaatgccgttatatttaatggaagatgtgattagtttaaagcgtaaatatggaattgaattaatcatgaaaaatgctactttattgcctgctgcggatattgtgaaacaatatgttggacaaaagcctttagctctcggtacaggttcacatcgttacgtcacggaaatgcttttagagaaatttcaattgcagtcttattttggtgctattgtgacagcggaagacgtgattaatcacaaacctgagccggatacatttttgcgttgtgcagaattattaaatcttgatccgttaaaatgccttgtatttgaagatgcggatttgggcgtacaagccggattagcggcggaaatggatgtttttgacgttcgtgtaaatcaaataattacaagcaagtgattagattttatctgtattttgtgtaatctaaacatttaggcagagtagagaaatagttgccaaccttatttttgattatgtttgtagcttttatttaaaaaatactttataaacataaagttgtgcttttttaatccgttatgattatttcacgtttgctttaactctttaaaaagacccttggttctatttattgtcctttcaatatctaactcagaatatttctcgaaagtaaatagataattgtgatattgctttaaactagtataagctacttttattggcaaaacagttgtttattcatttttcaaaaataaagcttaaagccttgtgctataaggctttaagctggtttttagacaactattttgtctgctttagaatttataatttacatttaaaacaaatgtgcgtccttttgaatagttgtttaaggctttctggtatccatcgcccacgcccatagcataagtcatttggtttgccgagtcgttattcgcatctagcggattaatgtattttttatcaaaggcgttttgaatttcgcctttaatagttaagttttccgttggttggtagatagcgtaaaaatcgaaaattattggctgtgctttgatttcttccgtgccgctaattcttacataagtaagaaatgtctcgccagtctttctagaagtaaaagttcccggcaagataacatcgccatctgctttatcaagtctggctcgtttgcttttaccatagtatttagcagtaccgcctaatgttaattttccgtcaaataaacgtgttcctaggtcaagggaaccgtaatctttcggtagagacgatattttacttaagccgaacccttgtaaatattgtccggtttcactatcatcactcacattataacttgaatcagaaaatgaacttggttgattggttttttgtctggcataagataagttggcatagaaccaaccgatatcataatttaattcaagttccaacccctgaattttaacaataggtgatgaatcagcaggaatgagttggtttgaaggaacttttgtttttccatctcctgtatccaccaagtctgttttcaagattgttttaccgccttcatagttaatatgcgtaagatgttcaacgcagtcataaatagtcggtgctttgtttgatcctctccacgcgtttgaactacattcttgtttgatattgataatataatctctgattttcgtttgatacgctaaaatcttaaagcctagtgcatcaaaatccgagaatatcccatttttataaccgttaatgccgaattgaatggttttggctttttctgattttaaatcgggtcttatggctaatgtaccaaattcggagaaatacatctctttgatattcgggacccgatgggttttggcataactcacaaatggcgaaaagagcgggtgaaaatccgccgagaaagacatagaataattatcatgagatcttgaatctcccttgtggacagagtaaaaacttgggcagttataaacatcccaagtggtatcatcatcattaggaccagtataacaccccaatttttctgcttcctcaacaccatacttcgcaactatctctgatgagttggaattgacccaaattggctttccattcttcatttttttatgagagtcatgccatgttctagatgaaaatctatctttaggatcaagagggaaaatcctaccttcgtatttatagatttggcgattggcattgacttttaaggtataaatatcgtatttaaaggtttggtcaaaatagagggttttaaaacgttgttcgccgtcgggttggaatgtattcgatcttatgccgtgatatttacatgcgtttttatacttaccaacctcatcacaagcatcaagtgaattaggttccccaccatcaaaataataacctaattcacgaggatgtcgatttttactgtatttatttttgaggatattggcacctaatgttgcttcataagagaatttttctgtgaatggaatagaaaaatgcatatttatatccgtggttttcgcactatttttgctttccaacacatctttcagcattttaccattaaacacgcttcccttgtgataggtttgcgtagaggtattatccgccaagattaattcaaattgtaaattctctttcggttttagttggtagtttaactggtagtttttattctctaaatttctgccggaaagtgcggtcgataaagagcggtatgataggatagctttattatatttatcgttatattcgattttggctaaatggctttggggatagtggagtaatttgcttgggtcatagggttgtaatccatagagttttcgtttttcatttctgtcacaaaatgcttcgcctttacaggcttcttcaactattcttcccacttcttcagcgtcaacatcttttatacttctacccccccccactttaaaatcttgcgagcttttacgccaactataggcatacataaaacctaatgttcttgtatcggaaaaaggatagcgaaaggcaactgcacccatataattcggtccggttgcattggttcctccgccaacatttaataaagcacctacatttctgccttcacttattacgtcatcaacaccgattgttctaaaatttgccgaacctactagagcattagcccccgctttaccgtcaaaacttcctcgttgaatatctacactggtaataaacgcagggtcaatggttgcaccgaattgagaggttccaccggctttttcgctgttatctcctgatgtggcaaaaaaggtttgggaaataccgtccaccatcgtattcacccgtccaaatcccgtttgaccacgaacgttcaccgacactgtccccgaacttttatcaaggttggtaaacgcacccggtaccgttctgatgatgtcatcaatagactgcgttgacgtggaaatattttctctcacactggtcgcccccgcttttttaaagacttcctgtttaggtggtagcttatattctacgttaatttgatcgagcatttcttctgcataaacacaagtgcttaatacggaaaaagctaccgcagtgagtttaaatttattagtcatcatttttatcctagttatttatgattaaattcatggtgtaaacatgtacgaccagttatataaaaatatcctgtgcatgtcaattaatgataataatttttattattatttttagtttatgcggaaattcagcatgttatcaaaattgatattcgccagcctgaaagctagagtttggctctggcggaaaacatgctttagttaaaaatgattcggaggaaatgcggtctattttttacaaagatttatctttaataaaaggaaactgaatgcgatattttatcgccagcattctgatgagtgtacaggttataattgccagccatggacttagtaggggagaaattaagcctgtcgaacctaatagttctatggttgcaccgacaatggctgcacctgcatatatttcagattgaaaaattaacggcgatttgtttgtcaatacatctcggatacagccaccacccaccgcactaatacaacccaaaataatagataattggatattttccgtcatataccacgttttattcgccccgaacgctgcaaaaaaacctaatccaacggcatcaagtaagttgctcacctttgagaacgacgttattttttcttgaaaaaaagatacgcaacacacggctaaaaggataattaatagataggcgatattttccaagcctgccggcggtgttgctgataggcataaatctcgaataattccaccgcctatcgctgttactgctgagacaacaaaaacaccaaataaatcaaattgtttcttcacgccagcaaccgcaccacttaaggcaaagataaatgtaccgagaagatcaatgaaattaaatacggataacataaaataccttaatcttaattttaaagcatcattctagcataacgaaattaaaaaaaaacttcgcagatgtaatggacacaaaaggattctatacattaatgaagcaaagtgtacatttgtacattacatcagcatagttgttatggtaatctagaagaacaaagtgtgttgaaaaaagagattcttggcgtaatgccgattttaatatttaaacgaaatatcctaagttatggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgccgctttgaaagttggtcaaccggtagatttagagcgtgtcgggttgtttgctgacggtgtggcggtaaaacgtatcggtaatgaaactttccgtgtatgtcaacaatatattgatgatgttgtacttgttgacagcgatgaagtgtgtgcggcaatgaaagatatgtttgaaaatgtgcgtgctattgcagagccatccggtgccgtatcattagccggcttaaaaaaatatgtgaaagaacataatattcaaggtgaaacgttggttaatattttgtccggtgcaaatttaaattttcatacattgcgttatgtgtcagaacgctgtgaaatcggtgaaaaacacgaagcaatttttgctgtaactatccctgaagaaaaaggtagtttcctacgtttttgccatctgttaggtgatcgtcctgttaccgaatttaactatcgttatgctgataaagaacaagcctgtatttttgttggggttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgaacatgatgaaattcggttcaatggtcatttagaagaacttgcttatacttatcaagatgtaacggacagccccgcttacaaatatttcttagcttgatgcacgataaaatcaaaaaatgccatactgaatggcattttttctactcaacttctttaattcgcaactctttcggcacttcaaaaacggtattttcttcgcaaccttcaagttcttccactttatcaacacctaattcttttaaacgggaaatcaccgattgaaccaatatttccggagctgaagcaccagctgttaaaccaataactgtaacattatccaaccaacttacctcaatatcatttgcatcatcaattaatttcgccgtaacacccattcttgaggcaagttcagccagtcgattggaattagatgagtttttagaacctaccacaataactaaatcggacagtttggctaattcacgaactgcttgttgtcgattggttgttgcatagcaaatatcatttttgcgaggaccttgaatggcgggatatttttgttttagcacctcaattacaccggcagtatcatcaattgataatgtggtttgtgtcataaacgtgatgtcttcatcattccgtaaagtcagtttggcaatatcttccacatcttctactaaataaataccgcccttatcgttatcatattgtcccattgtgccaatcacttcggggtgtccttcatgcccaatgagaatggcttttgttcctttacgactggcacgagcaacctgcatatgcacttttgtaaccaaaggacaagtggcatcaaatacttttaaattccgctctttagcctcttgacgaacagcttgcgaaacaccgtgtgcagaaaaaattacaatagcaccattaggtacttcatctaattcttccacaaaaattgccccacgctcacgcaatccattcacaacaaaacgattatgtacaacctcatgacgcacataaataggtgcaccgtgaatttctaatgcaagctccacgatactaatagctcgatcaacaccggcacaaaagcctctgggattagccaaaataattttcattagttttgcttactctcttttttatcgttttgcttaaaagcatcaatagccaataatccggcaccgatacaaattgcaatgtcggctacattaaacacagggtaatgccattgttgccaataaaaatcaaaaaaatccactacaaagccatgataagctctatccgccgcgtttgccaaagctccaccaatcattaacgcatagcctgtattttgtagtttctgtgttgcttgatttttatataagaaaaataaaatcatgaaggaaaccgctaaagccaataaaataaaaaagtatttttgccaacctgcatggtcagccaaaaagctaaatgccgccccgtgattacgcacgtaagttaaattaaagaaaggtaaaatgttaacactttcgtataaagaaaaattttttactacagcgagttttgttattaaatcagtaaaaaaagcaaccgcacttatccaaagaaatggaagtcctgtttttgataaattcatatggtttccaatagacgaaaaacgggcgtaatataacacccaatttaaattatcttgcgattaaacgctcgtgcgttctgtttcgcaggatctactttgatagccgttattgtaaaatcttaaacatctctctaacggcagaaggattatatcttactttataccttatatccacgctctgaaagacggagatttacggcacgttgcgataaaattaaattctatgtgagtttagttcgattattctgttgtattttaaccgctcttttccagcaaaattgaataaattagaggataaaatttatttacttatattgccattgtttggaattttctctagaatttgagaaattttaaccccaaaacagataggtaatacaaaaatgaagaaaaaaatcacttttactaaatctctcatcgcttcagcgttggcattatcagcgagttatgtcaatgcgtctgctttccaactcgccgaggtatccagttccggtttggggcgtgcttatgcaggtgaagcggcaattgctgataatgccgccgttgtagcaaccaaccctgcattaatgagtttgtttaaagcgaaacaattctcatggggggggggtatacgttgattccaacattaatgtaaacggaaaaatagacgttagcacatcaccaattccttcttctcctgatattctaaatgttaaagccaatcaaaaaaatatcgtcccgaatacccttattcccaatctgtattttgtaacccctattaatgataaatttgccatcggtgcaggcatgaatatgaactttagtttgagaagtaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaacgattatccaattgtttattagttatagaaggcgtattttgatacgcctttttattttttactcaaaacatcataaaatcttaaatgagtaatctaataaatatgtcaagttgcgattttaggaaaatgtcagtattcaatatcaatcaggcaaattgacgttgctctccgttaccttctacgttttcgatacaacgcccgcaaatgtgagaatgttccttatttgatccgatgtctgtagaaaagtgccagcaacgagggcatttttccccatcggcacgttccacttttatcgctaagcctgtcaattcgctttcagctacatcggctttcgacaacggtttcactacgacttgtgaggtaatcaacacaaagcgtaactcattaccgagttgttccagtaatggacgaatttcctcgcttgcatagacggtgactttagcttcaagtcctgctccaattaatttgtcgttacgtgcttgttctaatacacggttcacttcggcacgtacttttaataactgttgccagtaagtatcgtccaatttatcgctttcatctaacccaaacaaaccatcataaaattcctcggtaaagacaaattcagcacgattatccagttttggcaagtagccccaaatttcatcagcagtaaaagataaaatcggtgcaatccaacgcacaagagcttctgaaatatgccataatgccgtttggcaactgcgacgagcaaggctatccgccttagttgtatactggcgatctttgataatatccaaataaaatgatcccatctcaattgaacaaaaacgcattaagcgttgtacaactgtgtggaattgatagttatcataagcttctttgatttcgttttgtgcttctaaagcacaacttactgcccagcgatcaagagaaatcatttcttcagggttaactaggtcgttttttggatcaaatccgtttagatttgctagtaaaaaacgagcagtgttacggatacggcggtaagtgtcgcctgcactgtttaagattttgtgtgaaacggcaatttctcctgtgtaatcggtggacgctacccataaacgtaaaatatccgccccgtttttgttccaaacttcacttggcacaataacattaccgagagatttggacattttccgacctttttcatccaccgtaaaaccatgggtaagtacttgcttataaggtgccttattgttagttgcagtagataacatcaacgaagacataaaccagccacgatgttggtctgacccttctaaatacatatccgtagatttaccgttaaattcagggcgttgctctaccacggaagcataagttgatcccgagtcaaaccacacgtcaagcgtatccggcactttatgataagtttttgcatcttcacccagtaattccgcaggatcaagatcccaccaagcctgaatacccgctttctcaacacgttttgctatgtcttcaagtaattctaaagtgcgagggtgtaactcttccgtttcattatgcacgaacatagtcatcggtaccccccaagtacgttggcgagaaatacaccagtccggacggtttgctaccattttatcaatgcgagcttccccccaactaggaatccaacgcacagatttaatttcgcttaatgcttttatacgcaaatcttgcgtttccataccgataaaccattgtggtgtagctcggaaaataatgggtgttttgtgtcgccagcagtgtggatagctatgtttaatacgttccaatttaagcaatgcacccgtttctttcaatttttccaataccaaatcattggcttcaaatacgcctttaccggcaaagaatggcgttgaagaaatgaatttaccgtcatttgccaccaacccagccatttccaaaccatatttttttgataccacaaagtcatcttgaccgtgatccggagcggtatgaactaaacctgtacccccatcaacggtaacgtgatcgcctagaataataggaacagaaaaatcgtaaaacgggtgatgaaaacgaacaagttctaaatcttgacctgttgtcgaacctaaaatttccagctgttcaatttttaacgcattttgtaccgcttgtactaattccgccgccaaaattacacgctcatcaccaagttgaacaagctgatattccaattctgcattcactgcaatcgcacggttagacggtaatgtccaaggtgttgtcgtccaaatgaccgcagacaatgcaccttgacctttaccaagtgcattgaatttttcttcaacctccgccgcacttaccgccgcaaaacgcacatagattgatggcgaaactttgtcttcatattccacttccgcttcagccagtgatgaagcacaatctaagcaccaatgaacaggttttgaacctttgtaaaggtgaccattttgaatcactttacctaaagtgcggataatttctgcttcagtttcaaaattcattgtaagataaggattatcccaatctcccagtacgcccatacggataaagtccgctttttgaccttcaacttgttcttttgcataatcacgacaagcctgacgaaactctgctgctgaaattttctcgttcggcttacctaccaaaccttctacttttaactcaatcggtaaaccatgacaatcccaacccggcacataaggtgtatcaaagccaagtgcggtcttagatttcataataatgtctttcaaaattttattgacggcatgaccaaggtgaagtgtaccgtttgcataaggaggtccgtcgtgcaaaataaaggttttcttacctttcgaggcttctcgcactttttggtataaatttttatcataccagttcttcaacatatctggctcacgtttagccagatcacctcgcattggaaaacccgtttcagggagatttagagtgtttttgtagtctgtcatattaattatttctcaactttataatgaatccaagattgttttcgcactggaatacacaaggataacccattgatttaccgaatttactaaacgaatttgtccattcagaaattcaaccatccaataatcctcaaaattaatatctgtagtattaatattgcattcttcatttgaccgagcataatctgcaccgcatactacttttgtcggcggaccatacttttggggcaatccatttaaaatatctttcacttcttgtacttcacgtgggaagggcggtctgttttggttataattcaaaatatcaattgcaatactgttcaatacttgtccattaaaataagcggttgcttctcgattattgccgttaaataaaaaatgctgacatttataagaatttaatggctggtaatattcccaaccggtgcataatttagagtcggcaatttgttgataggtcatgccgaatttaagatctttataaccgtctaaaatgatattttgggcaaaactcaagcagggaataaatgtacccaaaatcagcaacaaattttttaactttttcatgaaatgtcctaacagaatttcttgcattaacataatttatttgcaacaagaaaataagcaaaagcgatttagcattatacgcataaatccttaacggtcaaaggttcaagacttgctgaaaatacttttttgccacaacaacatcattttcaatctgatttttaagggcatttagagaaggaaattttttttcatggcgaattttatggcaaaattcaatttgcaaggattgaccatacaaatcacgatcaaagttaaacaaatgcacttccaataattgttttacgccattgatagtaggtcgcttgccaatgttggcaactccttgaaaaatatcgccattttttaaccgcacttttacaacgtatacacctttaattggattaacttgccgatgtaaataaatgtttgcagtgggaaaaccaatagttcgtcctaatttattgccatgagcaactcgtccataaatacgatatggcttacccagtaacttttctgccaacgctaaattatcttctgataaggcttggcgaatggcggtgctactaatacgctggtcatttaattgtaaacttcgattatcttccactataaagctttgttgttgcccttttttttgcagaagtcgaaagtcgccttctcgatttaaaccaaaccgaaagtcatcaccaatgcttaaaaacttcatcttcagatgtttcactaaacaatctgaaataaattgctccgcacttaattgggcaaaagtgcggttgaatttaacgcagaaaacataatctacacctaactgtgctagataggcgagtttatctcgtaaacgcataagccttgccggtgcttgatcaccttgaaaatactcataaggttgaggttcaaataacatcactacaacgggcaaattcagttgttttgctttcgcttttaaatgttgcaaaatggattgatgccctaaatgaacaccatcaaaattaccaatagttacagcacaaccctgctgttttaaaggctcgggtaaattatgaaaaccacgaataagttgcataacatcgcctaaaaataaaaatttcttgaaaattgtcgcacattatacgtataaatatacaatggtaaaagaatgcagcataagcttactttctgtttaaaattagaaaacgacaagcataaggatttttctcatctgccggacgttgttgctcaaattcaatctgccattcttgccaattaaattcaggaaagaaagtatctccctcaagttctgtttgaatttccgttaaatataatttatttgcttgaggaaggtattgcttaaataattcgcccccgccaatcaacataatttcatgatgattttctcgcacaaaatctaccgcactttgtagattgtctttccaaataatgccatcgtgttcataaggcgaacgagaaagtacaatattggttctattcggtaagggacgaccgatactttcaaaggtttttcgccccataataatgggttttccgccagtattttgacgaaaccaagcaagatcagccggcaaatgccaaggcatttgattatttttgccaatcacatgattttttgtcatagcaacaattatacttagtttcatttgctttccttcttcattatcaaaaatcaaaaaagtttatcagcgagagtgactatactacaggtttgtgtcgataaaacaataagccgggtaatgctaggccaaaaacaagtgctccaatgaggaaacctgttttgagaaaatattccgtcatttgtgctacacgttgttcattgaaaccataatgatgcaaatgaacaattgcgatcatggctttataagcgaaaacgcctgggatcattggaataaccgctgcgacagtaaaaactttcgggtgagccaaataacgatgcgataaatatacgccaataaacccaaccacactggcagctataaaagtcgcaaaaactaaaggaatatcgaaatgtactaagaaagttcttgtcccatgccccaatgcccccaaaaatgcacaatattttaaaacattcttaggtacattaaacactaaagcaaatccgacagcaggaatagctgcaaaaaacatatcatctaataactttaagataaggtccatgattaacgcccccaattggcaatatgtaaaaaacttagtgcaaatacaattcctaaacaagtaccaaaagttaatactgttgccaaagtccaacgtgcaattcccatattaatatgtccttttagaatatcggcaagcgaattaatcaatggaaaccccggtaccaataacaatacacttgatgctaaggctatttgcggatcattacctaattcatatttaacagccaaacccgccaccatagaggcaacaaaagcggttatagcaaaaacaatcaaaggattataatgacgcaaagctaaagtttgacgaataaacatagcgatagatgaggcgataaatgtgattaaaaaaacgattatatctccaccagataaatgggcaaagcaagcacaggacaatccgatcatagtaacaactacaaaacgattgtattttaaaggcttaataccatctaattttttgcgaatctgttgcagatcatatagtcctttttctgccataattaccaagcgttgtacctctgttaccacttgcatattaatgcctttatcaaggtttttgcgtaccgtagtaatgcaattgtgatcatataatgtagtaataatgacggcattaggtgtcagtgcacattccacactatctattcccaatgcaaaacctaaacgttgtgccatttgtacaatcaatgtactttctgcaccatgctgcaataacatctgtgcaacttgtgcacaagttcttgttatttctcgttgtcgaaatgagctattatcctctgtagtattcataaaaacacctcattctattaaaaaagatgaccgcacttattatatgcctttcttctgtatcaattttgttttaaatcataaaacagcaatgaaaatcgcatgatttttcctaactttaatggtaacttatggggaaatttttcaagtaaagacaactatggaaacacaaaaaacaaataaaaccattgtggtaaaatttggtaccagcaccttaacgcaaggttcatcaaaattaaatcgccctcacatgatggaaattgtgcgtcaaatcacacagttgcatcgagcaggctttcgtataattattgttacctccggagcgatggcagcggggcgacattatctcaatcatccgcaacttcctccaacaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaattaatgaaaatgatgcggttgcaaccgctgaaattaaagtgggggataatgacaacctttctgcattagtggctattttggcacaagcagaacaactctacttgctaacagatcaacgtggattatttgatagtgatccaagaaaaaatcctcaagcaaaactgatttccatagtcgataaaattactgatcatatccgctctattgccggaggaagtgggacaacgttagggacgggaggaatgacaacaaaaattagtgctgctgacatagcgactcgttccggtgttgaaaccattattgcaccgggtaatcttgaaaatgtcattgtcaatttggcttatggaaaagacatcggcacaaaatttgttgtgcagacagatcgcttggaaagccgtaaacagtggatctttgctgcaccggttgcaggtatagtaactattgatgagggagcggaaagtgcggtattgattcagcataaatctctattacctgcaggtattatcagtgttgaaggatgtttttctcgtggtgaagttgttaaaatttgtggttcgaacggtaaaaaaattgctttgggcgtacctcgctataacagcgattctctcatacaaataaaaggaaaaaaatcgcaagatattgaacagatcctcggttatgaatatggttctgttgctattcatcgtgatgatatggtcgtttattaatcagaaagtttttatcctgataaaataacaaccagcttgtcaaaagaatgtgtttagactactaaatgaagagcaaagacttcatatacttttgaagtcatatatgaataaaaacccagcaaatgccgggtttggaaaagagatataaaattaaaagaatttaaccgtttgctttctcaacttgactgaattcgagttcaaccggagttgctcgaccaaagattaaaacagaaactttaagacgccctttgtcgtagtccacttcttcaaccgtaccattgaaatcggcaaacggcccttcagtaacacgaatttcttcaccgggttgaaactctttgcgatgacgaggtttatctgcggtttcttgtacacgattaagaatacgttcggcttctttttgtgaaataggtgccggtttatctggtgttccaccgataaatcccatcactcgtggaacactacgaactaactgccaagtatagtcattcatttccatttgaactaaaacataaccagggaaatatttacgctcacttttacgacgtttaccaccaacattttcaactacttcttctgttggaactaatacttcaccaaactgttcttccatttgatgtaatttaatatattctcgtaatgtcgcagcaacacgaccttcaaaaccggaaaatgcttgaaggacataccagcgttttttggctgtattttctgtcatattagaaccttaaatccgttaaaaatgtaattaatgaaacgataaccgaatccaatccccataaaattaatgatgctattacagtcacagcaaatacaattaatgttgtttgcattgcctcagggcgagtaggccatgtgattcgtctcagctcaatacgagaatcggaaaaaaatcttctggctttcataccttgattagtaatagcggcgatacctaaagcaataagtaaagcaacaacaatacccacaacacgaagagctgttgaaaatttttctactaagtaaatattacttacagccgccacaataacaatagcaaccactaacaaccataaaaagccatttagacctttcgatttctgctcaatttccggagctgctttattttttgtaatttctaatgccataaattagtccatcatttaattttatactggaatcctatttgaacgagcaattctagcactttcttattttattgcctatcaaaaaatataaattacgtgctatttttaatcttaatgaaaaagggatctataagatcccttttctgtcgaaacctatacaaataggaattcggtattacttaatgatcttagcaacaacacccgcacctacagtacgtccaccttcacgaatcgcaaaacgtaacccttggtccatcgcaatcgggtgaattaagcttactgtcattttgatgttatcgccaggcatgaccatttcaacaccttccggtaattcaattgtaccggttacgtcagtagtacggaaatagaattgtggacggtaacctttgaagaatggagtatgacgtcctccttcctcttttgacaacacataaacttctgattcaaagtctgtgtgcggtgtaattgaacccggtttcgctaatacttgaccacgttcaatttcttcacgttttgttccacgtaataatgctccaatgttttctcccgcacgaccttcgtctaataatttacggaacatttctacacccgttaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcgtgtcccggacagtcaacgtgtgcgtagtgacgtgtcgctgtatcatattcaacgtgtgaagtgttgatagtgataccacgtgctttctcttccggtgcgttatcaatttggtcaaatgcacgtgccgcaccaccaaagtgtttggataatacagtcgtgatcgctgctgttaaagttgttttaccgtggtcaacgtggccgattgtacccacgtttacgtgcggttttgtacgttcaaatttttctttagacattgaaagtccctctaaaaaacacggttatcgatggtacaataacaccacattaacctaatgtatgatttacggtttaattaaaaggatagttgaaacaagaagtggtgctgataggcggatttgaaccgccgacctcacccttaccaagggtgcgctctaccaactgagctatatcagcgcctggagcgggcagcgggaatcgaacccgcatcatcagcttggaaggctgaggtaatagccattatacgatgcccgcagtccataattcaactgtcccatcagaattcattattaagaatggtggagggagaaggattcgaaccttcgaaggctgagccggcagatttacagtctgctccctttggccgctcgggaatccctccacgcaaaaatgaatacttgtttactttagaatggtgccgactaccggaatcgaactggtgacctactgattacaagtcagttgctctacctactgagctaagtcggcatcgtaagcaagtgaggcgtattatatggaaaaaattacccctgacaagtcttttttcgaaaaaaaaacactttttttattattcgattaataatcaggcaaaatatataaaaattgtgaaaaaaacagttgatttagtctctttccagatacttgttttagcatttataatgtatatttttatctctttctgtcattttaagtagaatttatcgtggaagaactcaacactattaaactttctgaccacttaacgccttttttaacttttaatcggcaacagtgggctgaattgcgaaaatcagtacctttgaaactaacagagcaggatttgaagccactattgggttttaatgaggagctttctttagaggaggtgagtacaatttacttacctcttgctcgtctgattaattactatatagaggaaaatttacgacggcagactgtcctcaaacgttttctcagcgggcataatcctaaagtaccttatatcattagtattgcaggtagtgtgtcggtgggtaaaagtacatcagcccgaattctacaatcgctattggccaattggcccgttgcaagaaaggtagacttaattaccactgatggatttttatatccactggaaatattacagaagaaaaatttgttgcaaaaaaaagggttccctatttcgtatgatactcagcgattaattcgttttttagctgatattaaatcgggtaaaaaaaatgttaaagcaccaatttattctcatttaacctacgacattatacccaaccaatttgatattgttgatcgtccggatattttaattttagaaggtcttaatgttttgcaaattgggtctaataaatcaaatcaaatgttcgtatctgattttgttgatttttcaatttttgttgatgcagaggaggatcaattaaaagaatggtatataaaacgctttctaaaattttgtcgcagtgcttttacagatccgaattcttactttaaacattatgccaacttatctgaacaggaagccatcgaaaccgcaagtcaaatttgggataatattaatggcttaaatttgaaacaaaatattttaccgacaagagaacgagcgaatttaatcctaaaaaaaggagaaaaccacaaagttgaattggtcaaacttaggaaataaataaaaaataccgcacttttttaaaaagtgcggtatttttatccatattttaattaatgtaaaacatcaacaatatttaaaaagatgtttaatgctacgctatttaacagatcgataaagaatgcaccaaccataggcacaattaaaaacgctttgtgggacggtccgaaatgagaagtaactgcttgcatattcgcaacggctgttggtgtcgcccccaagccgaaaccacaatgccctgcacttaatacaacggcatcataatcacgtcccatcatgcgataagtcacaaaaatagaataggcagccattaccacaacctgtgctaccagtacgactaaaattggtaatgctaatccagccaattcccaaagttttaaagacatcaatgcgatagctaaaaatagtgataaacccactgtacctaacacatcaattgcctcatccgctactttgaacttcacaacatgagcgagtgcattacgaattaccgtaccggtaaataaacaccaaacaaacgtcggtaattgaagtgcggttccttttgtaagcacatctaaatattgcccgacaatcagacacacggacatcatcgtaatggtttcaataattgaacgagtattgattttgcgacgatatacgggcttttcaaatacctcttctatatcgtccacattttcatcttccagtacttccgctttatgcaagcgtttcaataagaatctggctaccggtccaccgataatccccccgaaaaccaaaccgaatgtcgcacaagccattgccagttccaatgccccttgaatgccaaaacgattacttaaagtttctgcccaagcagctcctgtaccatgaccacccgttaatgtaacggagcctgcgattaacccgtaagcaggatctaaaccaacaagcatagaggttccgataccgactgtattttgtagaataattaaaccaagtgcggcgaataaaaagataacgagaggtttaccgcctttcgctagacgagcaaagttggcacttagaccaattgagctaaagaacactaacatcattgtagtctgtaatttagtatcaaaactaaaactcatatcccaaaagtgatgcacaatgcttaagataatagccacaataaagccaccaaccaccggctccggaatattgtattcgctcaagaaatgtacacgtttcactaaaaaatagcccagtaataaaaccaagcaggctaatgccactgtttcataagtaccaaaagtcatattaacccctttttttgattgttgttcctgtatatattattaaatcagatactaggataggaaaaattagcaaaatatttttgcaaattcagcaagcctgtggaacgtaacaaaaaaaagcatttttgtctagcaaattacttctttatgtatcagtaaaagtaaaatttggtagatctatttagtcaaattcaagctcaaccgcattttctcctaacattgttaccagtgcactcaataactcatctgttggataaacagaccattgcacaccgaagcgtatcaaagctcgtccgtctttactttgatagtaaagatgtattggcaaagaaccgccgctacaaggttcaataattcctttgagttggcgaataaagtgcggtgttatttgctcttgggataagctgatggctaaattttttgcataacgactacgagcttcatctaaagtcattaactctcgtacagacatttttagcccttgagaaaaatcatcaaaactgactgtaccggaaacaataacaacggtgtccttctgtaatttatcaccaaaacgttctaaagcatcagcaaacaacgttatatctaaaagcccggaacggtcatctaaagttgcaatacctaatcggtttccttttttcgtcactgcaaatcttaatgctacaattaaaccgcaaacagtacttattttgcctcgagtgtttggagataactcatttaaacgtgtcgaactgtaatgagacaactcttttaaataacgagtaatcggatgactgcttaaatacaaacctaatgtttcacgctcaccgtctaaaatttgtttctcgctccaacgtggcgtgtgtgcataagcggtttcaacatcttcatggcttgaagttagtacaccaaacatatcaacctgtcctatcgcctcatcttttgcatgctgatccgatgctttcaacgcatcttccaaattttgggcaagtgcggctcgatgtggacccaatttatcaaacgcaccggatttaattagattttcaaaggtgcgacgattaatctgttttaaatctactctcgcacaaagatcgaataaatctttaaaaattccgccttgttcacgggctgaaactattgcatttattgggacttctccaacgccttttattgcaccaataccataaacaatttcaccattatcattcacactaaaatgatgtttgcctgtattaatatcagggggaacaatagtgagacccatacgtaaacactcatcataaaagctcacgatcttgtctgtgttatccatctctgaggtcatcaccgctgccataaattcagcgggataatgtgtttttaaccaaagggtttgataagaaaccaaagcataagcggcagaatgagatttattaaagccataaccggcgaatttttccactaagtcaaagattttcatggctaaatcgccatcaatcccttttgctatcgcacctttttcaaaaatatctcgttgtgctgccatttcttcaggttttttcttacccatcgctctacgcaataaatccgcaccgccaaggctgtatcccgccagtacttgtgcaatttgcatgacttgttcttgataaacgataaccccataggtaggttctaaaatcggcttaagggattcatgttgatacttaacatcaggataagaaacaggttccactccgtgtttacgatcgataaagttttgcaccattccagactctaaaggaccggggcggaataatgctacaagtgcaataatatcctcaaaacagtcgggctgaagtttcttgataagatctttcattcccctcgactccagctggaagactgctgtggtttcagctttttttaacaagttaaatgaatcgggatcatttaaaggaattgtcgaaatatctaccgcacttttaccctctttaaccaaacgagcgttaatcatatccaatgcccatttaataatggtcagcgtgcgtaagcctaaaaagtcaaatttcactaatcctgcatattcaacatcatttttatcaaaatgtgtaacaggatgtttcccttccgagtcgcaatatagaggtgagaaatctgtaattaaactaggagaaataactacaccgcccgcatgtttacccgcattacgtgttactccctccaattttcttgccatatcaattaaggctttcacttcttcatcattgttataaatttcggataatctcggttctgcctcaaaagcctttgtcaaggtcatacccggatcggcgggaattaatttagcaatacgatccacaaaaccataagggtgtcccaatacacgccccacatcacgaataaccgcttttgccgccattgttccaaatgtgatgatttgcgaaaccgctccacgcccataagtttctgcaacatgctcaatcacacgatctcgcttgtccatacagaaatccacatcaaaatccggcatagaaacacgttcaggattgagaaaacgctcaaaaagcaaatcaaattcaagaggatccaaatcggtaatttttaacgcataggcgactaaagaacctgctccggaaccacgtcctggtcctacaggaatatcattatcttttgaccactgaataaactccatcacgatcaaaaaataaccgggaaagcccattttattaatgacatccagttcggtttgtaagcgatcatcgtattctttacgtttttctgaccgcacttgcggatcaggaaacagggtctgcaaacgctcctctaatccctctttcgatttttggattaaaaaatcttccggacttaagtcacccgttggaaatttcggtaaaaaataagtccctaagcgaatagtgacattacaacgttgtgctattaatacagtattttcaagtgcggtaggaatatcagcaaacagctcacacatttcttgctccgagcggaaatattgttgtgaactgtataatttcgggcgtttcggatcatccagtgtataaccatcatgaatggcaactcgaatttcatgtgcctcaaaatcctccggacttaaaaaacacacatcatttgttgctactaaaggtaattgtttttgctgtgcaagtattaaagcagattgaatatagcgatcttcatcggatcgaccggtgcgacttaaacttaaataaaagtggtcgggaaaatattcttgataaaaagctaccgcagtttccacatcagcagaattatttttcagtaattttttccctacatcgccattgcgaccaccggataaaatgataattccctcatgatgttctgccaaccaagactgatcaatgtaaggtaaattataataaccacgttcataagccttcgaaagtaataaggtaatattatgataaccctcgttatttttggctaataacgtcagttcaaaaagttcatctcccaacaaatcacttttcacgagaacatcagcaccgataataggcttaacgcctgaagattgtgcttcaccataaaaacgaactaagccacaaaagttagtaaaatcagtcaatgccattgccaccatttcatgttgcacacaggcttttatcaaaggttttaccttagtaatgccgttaatcatggaaaaatcactgtgtacacgcaaatgtacaaaacgaggctgtgacataaaaaatcctataaaaataatttgagggaaaaagtgcggtgtattttagcgatatttctcaacaagctcaatcaaaggcaaaggacaaaaattccggcaaattattaccgcactttgaaaaaaagaaacccgactaaaagccgggtttaatttagctaaaatgaactactgttttgcaacaaccttcccatcaacataatccacaatgacttttttacccggtaataattgtccggataagatttgttgtgctaatggattttcaatttcttgttgaatggcacgttttaatggtcttgcaccgtaaatcacatcgtagccaacttcaccgataaaatctaaagtcgcatcggtaaattcaagctgataaccatgagtttccatacgtttcactaagcgttgtaattgaatagtggcaatggcacgaatattttctttagctaatggatggaataccacagtttcatcaatacggttgatgaattcaggtcggaaatgttgccctacaactgacataacaacctctttcatagcattataatccaactctttattgccttgaattaaatcagagcctaaatttgaagtcataatcactacagtattacgaaaatcaaccgttctgccctgtccatcggttaaacgtccatcatctagcacttgcaataaaatattaaagacatcgctatgggctttttccacttcatcaagcaaaatcacagaatatggacgacgacgtaccgcttcggttaaataaccgccttcttcataaccgacatagcccggaggtgcaccgactaaacgtgaaacgctatgtttttccataaattcggacatatcaatacgcaccattgcattttcgtcatcaaacataaaattcgccaaggttttacacagttccgttttccctacgcccgttggtcctaagaacaagaatgagccaataggacgatttggatcagataatccggcacgactacgacgaatagcatttgcgacagcaacaaccgcctctgattgtcctacaacacgcttatgcaattcttgttccatacgcaataatttatctttttcgccctccatcatttttgcaacaggaatgcctgtcgcacgtgaaagcacttcagcgatttcctcatcggtaacacgatttcgcaataaagtcatctcttttccttccgcactttcagcttgtgcaagctgtttttccagctcaggaatacgaccatactgcaactcagacattttcgcaaaatcactgattcggcgagcttgctccatttgaattttggcattgtccagctctgccttgatgtgttgagcacccgaaagtgcggctttttccgccttccaaacgtcttccaactccgcatattcacgttctttttcaccaagctcttcctcaagaagatccaaacgcttgcgacttgcttcatcatcttctttttgtaacgcttgttgttccaattttaattgaataatacggcgttctaatctatctaaaggttgtggcttactatcaatttccatacgaatacttgaggctgcctcatcaattaaatcaatagctttatctggtaattgacgatcggaaatataacgatgagaaagggtcgctgccgcaacaattgccggatcggtaatttgcacatggtgatgaatttcataccgctcttttaacccacgtaaaatggcaatcgtatcttcaactgtcggctcaccaacaaataccttttggaaacggcgttcaagtgcggcatctttttcaatatattgacgatattcatctaaagttgttgcacctacacaatgcagttcaccacgagctaaacttggctttaacaaatttcccgcatccattgccccgtcagtttttcccgcacctaccatagtgtgaatttcatcaataaataaaatcacacgcccttcttcttgagctaattctttgagaaccgcttttaaacgctcttcaaattcaccacgatatttggctcccgcaattaacgctcccatatccagagaaagaacacgttttccttttaagccttcaggtacttcaccgtttacgatacgttgtgccaacccttccacaatcgctgttttacctacacccggttccccaattaatactggattattttttgtacgacgttgtaaaacctgaatggcacggcgaatttcttcatcacgcccgataacaggatccaattttccactttctgcccgtgcagttaaatcaatagtatatttttctaatgcctgacgattttcttccgcaccttgttcattcactttttcgcctcctcgcaatttatcaatggcttgtagtaaattttcttgttttataccgcactttttcaaactttcacttaaagcacctttatcttcaagaattgctaataaaaataattcagaggaaataaatttatcttgccgttgttgtgccagtttgtcgcataaatttaataatttgaccaaacttctggaaacctgaatatccccattattccccgaaacttgtggtaaacggctcaattctgcagctaagtcattatgcaataatgctaaatttcccccacttgctgttaataatggcgggattgaaccatcttgctgatttaaaagtgcggtcattaaatgaactggttcaataaattgatggtcttttcctatggctaaagattgagcttcagcaatagcttgttgaaatttagtcgtaagtttatctatgttcataatctctcctaaaattaatttctgcgtttcatcgtaaaaattaaccacataatgaaacgccttctattcgctcactagttaagtaagattaaacaacgatatttcaagtagaaaagtaaaataaatttagtaaaacctattaattaaatgaattttaataggttttacaataaatagagggcattaatgaaaaagttttttcccaaagaaaaataacaataaaccgaaaccgatgacaacaaaaccgataagttgccaaacatttaccgctctttgcgtcattccgattaaaccgaaatgatcaatgatcaaagcagtcagtaattgaccgacaataataaagaacagcatattggtgacgccgattttgggtgcaagaaagatagtggtaaataccgctaatgcacctaataaaccgccgatgagtttccataagggctgtttagggacttgttgtagtgctgaaaataaatccattttccaccagcaaatgaaaaataacgctatcgttcccatcgcaaaggaaacaaaggctgcaaagacaggttgtcccgagagagattgtgctaactgagtattaattgccgcttgtgcggctaatgcgatccctgcacataatgcaattaatataaatggaagtaacatttttattatcctttaaaaaattcagtgaaatgaattgcattctatacttttcaagcaaagatacaaaagctaaaatgtcgcaataatataaatcctataacatgtgctccaagttcaaactttttccataaaaaatgtatgatagacatgttattaaactaaatagcttttaagggaataattatgacaaacacaaacgtacaactcatacaagaaggcgtaaatctaatgctttccggtatgggctttgttttagtctttttattaattttaatttttgctataaaactgatgtctaaacttatcggttacttttcatctgaaccaacccttcctcagcaagcgtttattcctacaacagaattaaatgatttagagcgtttacgtccggttattgtagcagcaatagcacatcaccgtcgtcaacaaaatttacaataacggagaatataaatggctactcacgagaaaaaaatttctataactgacgtggttttacgtgatgcacaccaatccctttttgctacacgtttacgccttgatgatatgctacctattgccgctgaactggataaaatcggctactggtcgcttgaagcttggggaggtgcaacttttgatgcttgtattcgctttttaggggaagatccttgggttcgtttacgtgagttgaaaaaagctattccgaacacgcctttgcaaatgttattacgtgggcaaaatttattgggctatcgtcattatgctgatgatgttgtaaataaatttgttgaacgtgcggttgcaaacggtatgagcgttttccgtgtatttgacgcaatgaatgatccgagaaatatgcaacaagcgttaagagcggtgcgtaaaaatggcggacatgcacaaggtacattgagttatacaacaagtccggtgcatactttagaaacgtggttagataccacagagcaattgttagaaatcgggatcgactcgctggtcattaaggatatgtccggaattttatctcctgtcgaggcatacaaattagtcagcgaaatcaaaaaacgctacgatgtgcgtttacatatgcactgtcattcaacgacaggtatggcggaaatggcattactcaaagccatagaagcaggtgcggatggtattgacacggcaatttcctctatgagcggtacttacggacatccagcaacagaggcattagtagctacattagataacacacagtacgataccggattaagtattccacaacttgagcgtattgctgattatttccgtaatgtacgcaaaaaatacgctaaatttgaagggcaattgagaggcgtggatagccgtattttagttgctcaagtaccgggaggaatgctgactaatttagaaaatcaactcaaacaacaaaatgcttcagataaactggataaagttttgcaggaaattccaaaagtgcgggctgatttaggctatattccgctagttacaccaacctcacaaattgtcgggactcaagcagtgattaatgtattaatgggtgagcgttataaaaccatcgcaaaagaaaccgcaggtattttgaaaggggaatatggtcgcaccccggcaccggtgaatgcagaattacaagcacaagtcttagcgggtgagcaacctattactgatcgtccggcagatcatcttgcaccggaaatggataaactatccacagaaataaaacgaatggtaaaagaaaaaggtattcaacttgcagagaatgaaattgatgatgtattaattgttgcacttttcccacaagttgggctgaaattcttagaaaatcgaggtaatccgaatgcttttgagccggtaccaaccaacgaagtaaaaacaagtgaaaaaccgaccgcactttcaagtagaaatgatagtgccgtttacacggttgaggtagagggaaaatcttttgtagtgaaagttactgaaggcggtgatattagtcatattacacctgtctcgaccgcacctagtacacaatcaacagaaccggcaacaagtgcaactacaaaaaatataccggtaaatgcacctatggctggaaatatctggaaagtactggtaaaagaaggacaacaagttgcggaaggagaagtcttgctcattttagaagcaatgaaaatggaaacagaaattcgagccgctacctcaggaactgtacagggtataaaagtgaaagcgggtgatactgtggctgtgggtgatatcttattaactttagcgtaatcggagattaatatggaaagtattctcgccctattacaaggaacaggcattatgcatttaagttgggggcaggcaattatgcttgtcatcagcttgctcttactctaccttgcagttgtgaaaaaatttgaaccgctcttattgctaccgattggatttgggggactcttatccaatattcctgaagcgaatatggcgttttcggcactagaaaatttacttcatagcaataacaaccaacatttatctacgcttgcaaatttactgcatagcgataccgacgtacaggcaataaaacaggtactggaaaaagcaccggcgttgttacatgtgcaagcagaattattagcgaaagatttaggctataccgatggtgtgttgtccactttttatgatgtcgccattaattcaggtgccgcaccattgattatctttatgggggttggtgcaatgacggattttggtccattgcttgctaatccaaaaaccttattactgggtgcggctgcacaattcggaatttttgccactgtgctaggggcgttagcattaaacgggttagggatcattgaatttaccttgcctcaagctgcggcaatagggattattggtggtgctgatggtccaaccgctatttatctggcaagtaaacttgcccctgaattattgggggctatcgccgttgctgcttattcctatatggcattagtcccacttatccaaccgccaataatgcgtcttttaaccactaaacaagagcgtaaaattaaaatggtgcaactgcgtaatgtcagtaatcgggaaaaaatcttgttcccgatcgtgttattggtgcttgttgctttattattgccggatgccgcaccgttattaggaatgttttgctttggtaatttaatgagagtaagtggggtagttgagcgtttaagtgatactgcacaaaatgccttaatcaatattgtaacaattttcctcggattatccgttggtgcaaaattagttgcagataaattcctacaaccgcaaacgttaggtatcttattgctcggcataatagctttcgccatagggacagcgagtggcgtcctaatggcaaaattgatgaactgctttagtaaagataaaatcaatccgcttatcggttcggcaggtgtttccgccgtgccaatggcggctcgagtatcgaataaattaggcctagaggctgatcatcagaactttttattaatgcacgcaatgggaccaaacgttgccggcgtgatcggatccgccattgcagcaggcgtgatgttaaaatatattgcagcaatgatgtaaaaatcattcccttaagattgaaaataaaaataaggacgaaaattttcgtccttattcatttttaatacaatgttagaatttctctagtaacattttttccaatttttcttggtcaatagcaaatttacggataccgtcagctaatttctcaactgccattggatcgctattgtgttgccaataaaattggctttcggttaacggttgaggttttgctttaacttcacctttaaacgctaatttacgcacaagtgcggtgctattttcttgtaattcttttaataatgccggtgcaatagtcaaacgatcgcaacctgccaattcagtaatttcacctacattacggaaacttgctcccataacaacagtgttataaccgtattgtttatagtaattgtaaatttttgtaacagaaatgacgcctggatcttccgccggtgcatattctttcttatcactgtttgctttataccagtcaagaatacgtcctacaaaaggtgaaattaaataaacacctgcttcagcacaagctcgagcctgtgctttagagaacaatagcgttaagttacaattaatcccttctttttcaagaatttctgcagcacgaataccttgccatgtagaagcaattttgatcaaaatacgatcgttgctaatacctgcttcgttataaagtgcgataagtttacgtgctttttctaccgttgcttgtgtatcataagaaagacgggcatctacttcagtagaaatacgtcccggaacaatttttaaaatttctaaaccgatatttactgccagtttgtcttctgcatcaattagttgctgtgttttatccgcactttttgctttcgcataagcaatcgcttcatcaattaatggagcatattgtggtaatgatgatgcacttaaaattaaagagggatttgtggttgcatcttgcggctgatattttttaatcgcatcaatatctcccgtatcggcaactaccacggtcatattacgcaaagcgtctaattgtgttgtcatagtctttccttttatttagctataaagaattgaactcgcatacaataccatatctttgaaattatgaaatcattattttgcttttaagcgtacagaataagtatattcttcaccttatttataatgctttttagcacaattttatttataatcgagggcaatttttggcaaacaaaatagctcaacaatgaaaaaaaattattacactgtactttctctgtcaattttgaccgcactttatagcacgtccagtcaagcgaacttacaacagcaatgtttgatcggtgttcctcattttcagggtgaaatcgttcaaggcgatcccaatgaattgccggtttatattgaagcggatcacgccaaaatgaatcaatcgacacatgctcaatacgaaggaaatgttaatgttaaacagggcaaccgtcatttaacagcgggaatgattgaaattgagcaacacggaaaagataatgcgaaacgttatgcgtatgctaaaaatgggtttgactacaaggataatttaattcagctcaatggtgataatgccaaaattcaccttgatagcaaagatgccaatatccaagatgcagattatcaattggttggacgacaagggcggggaactgctgatgaagttgaacttcgtgaacattatcgagtgatgaaaaatgcaaccttcacatcttgtttgcctaatagcgacgcttggtcaattgaggctaaggaaatgcgtcaacatattcaagaagaatatgcggaaatgtggcatgctcgttttaaagtatccggtatccctattttctacacgccttacttacaattacctatcggtgatcgccgtcgatctggattacttattcccaaagcaggtatctcaactcggcatggttattggtatgcacaaccgttttattggaatatagcaccaaactttgatgcgacatttacccctaaatatatgtctcatcgaggttggcaattaaatgcagaaactcgctatctgactcgtatcggtgagggaaaatttgtcgttgaatacttaaaaacagatcgtcattctgactatttaaatacggctcgttcacgtcatctcttttattggggacataattctcattttctaaaagattggcgtttaaatgtaaattatacaaaagtaagcgataaacattatttcaatgattttgagtctgaatatggaaacagtacagacggatatgtagatcaacaagcgagcatttcttactatcaaccgaattacaacctttctatttcagcgaaacaattccaaattttcgataaagtagatattggaccttatcgtgcgttgccacaaattgattttaattattatcgcaacgaaattgctaatggcttagttgactttagtttattttcacaagtagttcgttttgataatgacagtgcgttaatgccaactgcttggcgtttccatatagaaccgagtttgacttttccactttccaatcgttacggcagtttaaatattgaaactaaactttacgcaacacgctatctacaaaaacgaggtaaaggagaaaatgcagaagagattaaaaaaacggttaatcgtgttttaccacaaatcaagctggattttcaaacggtcttagcaaatagacaaagtttcattgagggttatacccaaactcttgagccaagatttcaatatttgtaccgcccttataaagatcagtcggatattggtctaaaacaacaaaataatgattacttaggttttggttacgactcaactttattacaacaggattatttttctttgtttcgagatcgccgttatagcggtttagatcgcatagtttcagcaaatcaaattactcttggtggaacgaccagattttatgataaaaatgcaaatgaacgctttaacttatctattggacaaatttattaccttaaagactctcgcacagataataatccacaaaatatggctcaaggcagatcttcttcctggtctttagaaagtaactggcgtatcaatagcaaatggaattggcgtggaagttatcaatatgacacacacttaaaccaaacatctttggcaaataccgtcttagagtacaattcggagaaaaataacttaatccaactcagttatcgatatgttaaccagtcttatatcgatcaaaatttaattggtaaaaatacttatggacaaagtataaaacaacttggtatgacaacagcttgggagctaactgatcattggacactggttggtcgctattatcaagatctcgcattgaaaaagccggttgaacaatatttgggaatacaatataactcttgttgctggtctataggtgttggagcaagacgttatgtaaccaatagagcaaatcaacgcaatgatgaagtgctttatgataatagcttaagcctcacttttgagttacgtggattatctccttcagatcataaaaataatatagatgaaatgctgaaaaaaggaaaactgccttatattaaagcctttagtctatactaacgttcaaatttaacgaaacacatcaaaaaacaaaccgcacattaagtgcggttttcttttagattatgttgaaaaattacagtacatcaacacagttcaaatcttcgaaagatttttctaaccgtttagacatagattcttctgctttgcgtaaccaaactcgaggatcatagtattttttattcggtgcatcaggtccttctggattacctaattgaccttgtaaataagcttcatttgctttatagaagtttaaaactccttcccaagttgcccattgggtatccgtgtcaatattcattttaattgcaccgtagctgatcgcttcacgaatttcttccgttgaagaacctgaaccgccatggaatacgaagtctaatgatttcgccggaagattacgttctttagaaacaaattcttgtgatgcacccaaaatagacggttttaattttacgttgcccggtttatataccccgtgaacattaccaaatgctgctgcgatagtaaaacgtggactgattggacttaattgatcgtaaacaaaaaggacatcttccggctgagtataaagtttagattcatcaacatctgagttatctacaccatcttcttcaccgccggtaataccgatttcgatttccaatgtcatccccattttatccatgcgggcaaggtattcacgacaaattgccatattctctgccattggctcttcggataaatcaatcatgtgagatgagaacaatggtttgcctgtttcacaaaagtgtttctcgcctgcttccaataaaccgtcaatccaaggaagtaatttttttgccgcatggtcggtatgaagaataactggaacaccatattctgccgctaatgtatggacatgtttagcagccgcaattgcacctaatacatccggacgaataccgctagccggtttaattccttttcctgcataaaatgccgcaccaccgtttgagaattgaataataacaggtgcttttactcgtgcagcggtttctaatactgcattcacagaatctgtcccaacacagtttactgccggaattgcaaagttattcgcctttgcgtaagcaaatactttttgaacgtcatcaccagtcagcacccccggttttacaatgtctaataattttgccatttttatatttcctatataacgtgcaattcttgcactactaaaaaataaatcaatctacaacgtaaagtataatgcttttcactttacaaaattaaccatttgctcgtttttctaaaatttcaaccgctggtaatactttgccctctacaaactctaagaatgcaccaccaccggtcgaaatataagaaattttatctttgataccgaataaatcaatcgctgccaaagtatcaccaccaccagcaatagagaaagcaccatttgcggttgcttcagcaatcgcattagaaacgatttcagtacctttacgaaagttagggaattcaaaaacccccacaggaccattccaaagaatagtttttgcattgcggataatatcagccaattgctctgctgatttatcaccaatatcaaaaatggattcttctccggaaacgtcggctacacttttttctgttgatagtgcggtttctgaaaattcagtgcccacacgcacatcaactggaacaggaatattcgttacttttgataaacgttgtgcttcaggaattaaatccgcttcatataaggatttacccacattatgcccctctgcagcaatgaaagtattcgcaataccgccaccaacaatcagttggtcagcaatttttgataagctgtccaagacagttaatttagtggatacttttgaacctcccacaatcgctaacattggacgctgaggctcttttaatgctttacctaacgcctctaattccgccgctaataatggaccggcacaagcaacaggggcaaactccgctacaccgtaagttgaggcttgtgcacggtgagccgtaccgaaagcatccataacaaatacatcacaaagtgcggcatattttttacttaattccggatcatttttcttctcacctttattcacacgtacgttttcaagaacaacaatttcaccttcattgacttctacaccgtttagataatcttgtgctaaacgaacgttaaaaccggcacctttcaaataatcaacaacaggctgtaatgaatcttcaggtttaaattccccctctgtcggacgacctaaatgagaagttaccatcactttagcacctttctcaagtgcaagttttaacgtaggaatagttgctttgatacgtgcatcggaagtgactttcccctcttttaccggcacatttaaatctgcacgaataaatactctcttacctgctaaatctaggtcggtcattttaattactgacataattcaccccttatattggttaaaattgataaaaactaccgcacattatacctagttatgaacaggttgtaacgaactagatcaaattggctttaatatcttgttgcataaattaaatcattaacaaaaaactcacgtttctattaataataattcaatccagaataactgaaatccctattcagttttcaacggatattctttataatcagccctttttacaacagagttaaaggacatggcgttactcatcactgataaatgtacaaattgcgatatgtgtttaccggaatgccctaatgatgccatttcaattggtgatgaaatttacattatcgatcctcatctttgtacggaatgtgtgggacattatgatacgcctacctgtcaaaacgtctgccccattaccaactgcattaaaatcgatccggaacatattgaaacggaagaacaactttgggaacgttttgttttaattcatcatgcagacaaaatataaaaaaaagggcgtataaccgcccttttttgatggatgaaaagtccagaattaccagctataaccaactcccgcacccacagaagttttcttatcgccatgtcctaagctgaacttaacgctaagtttgccgttatcggacactctggaataacctaccgcaaaggcttgactccccatatagttaccggtcgccaaacttaacgtactcttacctggtaatatattgatcggtaagttcgcttgtgcaacagcttgtgccacacccgcacgcatattgcgatcattattgttcatttgtgtccgcagttcattgtttttggtatccacgtagtttttgtttactaccacatgaccatctgcattaggtttaatattcggcacggtgataaccccttttgtaccatcaatgtgaatctgaccgcctgcaccgttcactgtcaatccgtttttgttcagctcggtacttagtgcggtcgtttgggttgaactgtccgcaaaacggataccacctgcggttatcacagccttatcgcttttgtttttatcttccaacaccaccgcttccgctccataagttgcagatttggctttatcatcagtgccatctttgcctttattgaccactctcaagccgttgctgtctaaagtagattttctaccctcaacttcacgggtttcaaaagaggtcatatttttcaactgatcggacaatttaacttctaagcctttgccgtcttgtgccatttccactttgatattgccggtagcagtgcggttgctgttaaatgttccctcgcctgtgatagacagggtttcacctacatttttatgcacggttacatcatcattaccgacaaaattcagccccgctcgtgccacggcttgtaaatcgccaacggtagcgacattgcttaaattagcttggctatccggttcaaccagttcttcgacttttgccatcgcctcggaaaaggcgttatagtccccatttgcttcaattaactcgttgcgtgccgattctacggcttcttcggcattctttttagcctcttgggcatctgataattgcgtttcgtattttttcaaattctcacgaattttctctttcgcttctccatcaggcagggtatcaatggtttgttttaaactgtccaccattaattctaaatcagcgagttttgttgctgtatcagaaagtgtttttgctttttcgcctaatgcttccactttctcattcactttctcagcaagttcactaagttgttttttctcatcttttgttggtgttgtaatacccaaaccgcttgccacattgctaatcccgataggtgcggtgcttggttcggctttaatcacgacttgtttcttctcttcctcagtaagtagttgatcaggtttaccgtcttttaattttttgaaattaccatctttatctttcacgactttttcgccattcagatagaaatcaaacgggcgattattgttcaagtcggacactttgccatcgacatagtttttgttggttgcaagggtgccgtctttttcatctggtttaatatcagcaagaccggtgattttgccggtgcctgtgccttttgcatcagcacctgttccagctccgcttccatttccgatttttgcaaacgcaagggtagcggattgaccgttaccaccattattgccttgactgttttcaccgtcagctactttcaagctcacgacttcttttgaactgtctttgccttttacagtcaagccgtctttaccataaacggtatgggttttgtcgccgttagctgcctctttatcgcccacggttaagccgtctttgtttaaggttgctttgccatctttgctttgtggtgtaagtgaaataccatctttattgatatttacttcagtaccttgattgccaacttggaatgtggcacctttttctgcatctaaagtcagtttagtgacttcatcttgatttccaaccgcacttgaacctgtaccgcttccgcccgcacttccagctttaggtttagaggaaatcgaagtgatgtttttcagttcctcagtcgtgccaatggttaccactgccgttgttgttggggtagtggtggttggcgtggtagttggtgcacttgttggcgttgtcgtagccatgcctgcaccatttgaaccacctgacgaagccatactatttgaaccaccgccgtttgaacctgcaccacctgatgaactgcttggagctgctgatgatactgatgctggagcagctggtgttggagccggtgcggaagcactcggactggtagatcccgtacttgatggtgttgtaccgtttttagctaaatctactttaatattctgaccactcgtaaacttcaacgtatcgttgcgaccgatttcgatagtcttaccgctaccattttcaaccttgaacttaaacttatctaatgcttgttcaaggtagcctttagtgatgagttcttttttccaatctgtacttccgctatttccatttacgccattatatgtttgttcttcagcaagcattactttgctaaatgtcggtgcatttttaaagccgatttcgattttggcgttgccgttagcttctctcgtgtattgagtgattaaattatcacctttaaactcagcaatatttggttgtgatgaagtccccgccggagctggtgtagcagacgaaccagcctgattcatatctaaacgcacaatgctaagggtcgaaccaagatagtgcggtgtgctttgagtgccatttgctaccgcacttggcatatccgcactgaacttcaagccttcgttgagtttagaaacagcatttttcaagccctcaacgatattttttggtgcagttccatctgttccattaatgtcttttaatttgaaattatcaaatgttggtgcggtaaatttcgttttatctgaagtatcaaccgcaatacctaactgtttcgctaaatccgccagttgtttacctgttacggcttcttttgaactatcaccgatttcaccgtctgcaaggtttgtgagttttgaatcattaaagctgatttcttttttagctgtttctaacgtgattttcgcaccgctttcatctttaccacctttgatactggtgatttcttgaagattattattaagcgtatgcgtaatttttccatcagcttctacagaaacagaaatattttctgacttcttaaagtccaaagcccctgttttgaggttgatagattgcttcgttttgtcatcactattcgttttatacgataacgtcaagtcgtccacatatttcttattaacggcatcgtatttatcagttggtgtggcaacataaacaattcttctttgttcatctttgccagcaccacctacagataccgcattggatacacctgttgatttattgcctaaaatgacagcatttgttatatctttagttgtcgtaatatttgaacccaaggcataaacatggtcgccctcaattttgttataagcacccacagcataggaatgctttccgataatctcattatctttaccgaatgcaccggaatcgttacccgatacattatttttgtagccgatagccgtagcatgctcacccaatacctgagcttctcgacctatggcaactgaacgtctatttttagcactcgtgtcataaccaatagcaattgccccttcattttctgctactgctttatcgccaatcgcaatagaaccctctccatcagccttagtttccggattatcggatactttaacggatttatcacctgtaccttttagatacttaataaccgcatccgcctggactaattcagtcgtacttttttcagtttcgccgagtttgatggtgtcaataccgacattttttcctaaagctaattttttatccccaatattcgacccatcaacttttaagaagtctgtttgcaattgtgctgttgtcgtgtattccttcaattttgttgctacggctttagaagtcacgactttttcatcagtttcagaaaccgtggttgctttatttaatttcagcgtaagtgtacccgcactttgaggattgttaccattagatggtgctaatgatacggtgatgtctttttgtgtggcttctgccataccatcggcttttaccttacttgttgaactatcaatggtcaacgtaccgcctaattgtaatgtggttgagcttggggagctaccattatcattccccttgaatgtcaatccaccattaactgcggtgattaactgattaatagcctctttaaaagttgtaggacctgtattgctattagttgtaccaccagttgaacttgtaccgccttttattgcagtaaatgatggttgtttaaatccagtttcactctcaacttcaacccctaatttacttgctaaatcatgaagttgtttacccgtaatggcttcggttgaactagtatcaatttttccatcttccacattggagattttcacggtatttccggtagtggctttagtaaatgtcaatgcacttccacccacttttaactccgctgttttatcagtgccacttgtactgtttttaaacactaaagcgttatcatcgtctttgccaatggtagataagccagtggcttgcactccgccatttgtcatgtcttttttcaacataacggttgagccgttttccggacttaactcaattttgttatccgctccattggtaactttaatactacccttatttttacccgcacttaacgttgcactagtgccatctaaagtaacgcttgaaccatctttagtactttctaaggtaaccgctttatctttcaattcaagttttgaattatctttcgcactttctaaagtggcagtgttttcagtgagttttaacgcacctttgccctcttctttattaatttcagacacgccgctaaatttacccgcacttagggtgacatcttttgatcttgcttgatcgcctgcggtgaatgttatcgtccctttatctttatccaaagcgatttttgctttatcgccattggcaatagaggcaataccttttaagtttttagacaatttaatttctaaggtgtcatcgccattgccagttttcttcgccacggtgatattgtccggtgcggtttccattgctggttgcgtgctatctgttggagtggttgctgatgtttcacccacaattttcaatgtctcaccgagtttgcgtgtgacatctttaccgtcatttccttggaatgacagccctttatttttcaattcattagcgatatgaagcaaatcgcctgcattgatggctttgtttaatttgccatcatttgatgttccaccattttgcggttgtcctgtggcaacaagttttaacaactcgtctaaatcttgtctgccactagcaccattcattttttgatctaaaccactcgcaatgcctgtgatttgcttattatttaagtctaatccatcagcttttaatgtcagatctgttcctttagaagagattttcagaccatcgccatttgcaaagtcaatcttcggagccgtgccactgtcacctttaccggcaatcgaagtgatatttttcagatcggcatttaatttatgcgtaatcgcaccgccagcatctgctgtgacagtgatgttatcatcatttttaaaatcaagaccttcggaaagtttaactttattatcacctgctccattagccttgtattttatctcttggttggcaatcgcttgctcgttttgagtcgctttactgtccacatattttttagtggttaaggcagtctttggacttttttcatttatttcttcagtgaccgttacttgtttaaaagacggtttatcttttatgccaattaaaagctcttttgtattttgttgatatgatgttttaatattatcgctactaaatccatcatcactggttgattttttatcgatattccccgctttaatctgcaaggtatcccccagttgaagcgtgccttttacagtaccatcgcctacgaccagtcctttattcacagccacgatcaaatcattgattgcttctttaaaggtggtttttccgttagtttctgtttgcccttgataattgactttggtaaaggacggttgtgtaaatccagctttcgcattatcgacagtcacacccaatttgcctgccaaatcatgcaattgttttccggtaatcgcctcatttgaagcaccgtcaatttgcccgtctcccagtccagaaatcttgaccttatccgtatcggattttgtcaatgttaatgccgcaccttcttcaggcattaactttattttcgtatctgctaaggagatttttgttttgtctttagcgatagactcaattcccgtcaatgttgaacttaatccataagatattttcttattagacttatctaattcaacagttaaattagaatcttttgctgcaaattctaaagtatttcctattaggttatcgctagtggcaccttctgccttaaccataaatgttttattaagtttatctttaataccttgatcgagttttgcctccgctattgtgttatcttttaattttgtccctgcaattgaagcatcttttaaacttaatgacgcattaccaaatacttttccgccaccagtaacttgaatttcatcgttaccagttaaagcattcaatccactttcaataactattttagaagccctgccgtcaccgtgttgaactttaacatctccagtaaccccatcaatagtaatttttcctgttttatttgtagcactatgaccaccactatcttttagagtgatagaattaatgtcttctaagtctttatttagtgctaccgtaaattctcccgtcttatcagaatttgttttagataatgaaacattgatattgcttcctgatttaatgacaacttttttgtcgttctcgctattttttctgacaaagtcattattcgtagtcccatcactaaaggtaatacctgccccatttaccgaagtgagcacctcatcaagagcagataaagcctctcccacggttgtgtatggtgccttatttccattagctagcgtataagacggtgctattacatttccgtctgcacctattttcgcctctccgcctaaagcactcacaacagaattgagttgcgatttgttaatggcatcattatcagatgtaccatttgctacgttggaaattttaactttgccactagaaccagttaaatttaaactggaaccaccagctttaaggattgtcccgctatccgaaaatgcgatttgattattggtatctttaccaatagatgtaatgcccgttaaagcctcttttaatgtgatactgacttttttagcgttcttatccactgccgtggtgatatttttagtatcgccattaatatttaagacattgttctgtttatttaatgtatatactacgttattatcccccttaacatcaaaattagcggcgacattagctaatttcccgtccacataggttttcgtggttaatgtcttcccatcactactatcatcgactgttccactcactttgacttctttaaaggtcggtttgtctttgataccgattaacagctctttgctttttgctagatacgctgttttaatattatccggtgaataaccgtcgtctgaagtgctcgttggtttatctacagctcccgctttgatgattaatttatcgcctaagtaatgcgttccttgttcattattagaatctccaacaccaaaaataaatcctttattaatagccgttgtattttgaccaatggcatctttaaaggtcatttcttttgatgtttgagtatttgtattcccattatatttaacaacatcaaaacttgattttttaaatccgctcgttaggtctgcttttgctcctaatacattaatagctaatttagaaaacgcatctactacgccatataactggcttccgttaatagcatcggtggagtttacttccactttacccgcagcaacgtgagtaatcaggtgttctttgccggtatcgccaacactgatcaccgattttttactctgctctttgtcatcagcactgactccgcctgtccagttgaatttaagactgtcattgccgacagtcacttttgcttctttaggtgcggtcattttatcgacagtttttgcatttttacccaatgcgagcttatcgccatctaccgtaatcatgcctaatttgtttttggtattttgggcaaaactgagagtaatactttgtttatcctgctccacttttgtctcaatttcatcactcgttcctgccactttaagtttttcgtttttcaaattcactttaccggtcggaccgctatttttagaattatccgcctctaaccctaaggttgtactaacctcatcaattttcgaatccaaataagttttaaccgctccggcggtgacaactttgtctttattgctatttgttgccgtattgtcatcaatgcttgttgctttgtgcaaagtaaaggtaatttcccctttgttgctatcagtcttagaagtcagatccgtaccattgcctttaatggtgagtttttcgcccaatttacgggtgatttcagagccggaatctccggcaaattttagtcctttttccacaatcgctttcgctacgttggataaatcgctgacattgacagcatttcctttaattgttgttatgtaactgccatctaatatttttgaaacattttccggatttccgttcgctcccttaggtccatgatgctgtgtatttaacccgctttgtaatcgggtaattcttctatcggacatatcaaagcccgttctatcaaatgtatagtttgccccatttgatgaaattgttacatttgtcgttgcatttgacccatttgtgctattaaatgctatcttgctatatacagtatttttaccgcttttaatcccttctccagtaatacttgcaatgtcttttaagtctttatttaaagatatttccaactctttttcattagttttagcttcagtagtaatatttttatgttggctagcgtctgctttccccttaatatttaatgcactttgaacaatatagtttcccatattaccatttacagtaaaactagttgcaacattggcaagttttccgtcgacatattctttcgttgttaatgtctttttatcgcttctatcattcacagtgccacttattgttacttctttaaatatcggtttatctttgataccgattaacagttcctttctagttggttgatagcttgtcttaatattatcactgctaaatccatctacatcagattttggtttatcgatatttcccgctttaatagttaacgtcgaacctaaattaagtgtacctgtatggctgtcagcgtcttggattacaattcccttatttaccgctgtaatcagttcttcaatagcgtctttaaaaatagttttttgtttcttttgagaacctttatagtcaaccgctgtaaacttataacgatcaaattgcgtgttattgggggtatttactgacacacctaaaatatcacccacatttttaagctgattccccgtaatcgcctgatcggaagtttgcgaaatctctccatcggctaaatgcccgaatcttatcttttctcctatgtccgcaatttgtttatcagcatttatgtattgtatcttctcgttatgccctttagccccaactaatactttttcttttggaatttcttgtttatctaatggtgtgccatttttggtattgaccttgtagaattttccatctgttcctttaactaatttatatatttttccattatcttccgtataataaacgactaagccttctctttttacatattctaaggcttttaattgtccaatcgtcgccacgtcagaatccaacgcacccggtgccaccccgacaatccgtcttaagcccagttcttgacttccactgttaccctttgtccaaccgactgaaatgatacccgctgatttatcagttcttaaactatagcttgacccctctggaacatatggggttaaatcaatggcttcttttccggttaaggttgctgtatttttgttagcatcctgataaaaatattttgtatgtgatttatagcccaaggcgacggagttttccatcgtcgcttcggtttcattacctaaagcgattgcactttttttactcgcttttgaattagtcccgaaagcaattgcattttcagaatttgcttcaatttttgcattatctcctaaagctatccctttttcagaataaacatatgattctgtacctatagaaattgctgacatttctaattctactttttcagcctcaagtccaaattttcctttctttaaatttgctatttttacatttttattttgactttgattttcaacttttgcactattacctattagtatagatttttttgaatgatcttttaaacttgcagaatttcctagaactatactttcacttgataatccatgagaaccataccctattgatattgtattgtcttttgtaacaccaactccggaacctattgcaactgctcctgcaccgatgacatttattcctgtaccgatagcaacagagttttctttatatacattagtaccaatcccaagtgcgatggtatttcgtgcatatttaccgatgttatttaatgcccctaatactacagagtttgctcctcttactactgatgcactacctatagtaatagtattatccccattatttgaaagatgatatcctaaagatatagagtgatctccttctttagttgttttatatattttacttgttgtttcaatgacttcatccctttcgtgactaaaggctattcgttttttgtcgctaattactttttcaattatctctgatattggatttttactattactagggttagaagcattaaaaccaagtttgacaatatgattttcatctccgtattttaaattgttctcatcgattttaaaaagggtgttatattcattatgtcgatctacttctacaacaggagatgaattttgtgtgtgttgcataatggaattttgaaatgtctcatacccattacttgcgattaaagcattagatgctacatttgaccctatggctattgatccaattcctactgcttttgatcctgaaccgaatgttaatgcaccttggttagttgcttctgtttcattacctatagcaaatgaattcgcagcaaaaacccttgattcgtctcctatagcaactcctccagttgcatcgtcattaacaaacgcacgaactccaactgcagtagaatcatttgctaaagcaaatgataatgtacctatagctagtgaagcatttccataggcaacagatcttgaaccaatggctattgatgccacgcctgctgcgtaagtaggagaataaatccggttatctacaccgttatttattccgtatttcatcttaaagttctgttcatttaatatatttttataagtagttccactatatcttgtgtttgtatcataaccatagattttcataatggttttttcaggtaatttgtctcgatatgtattagctatatcatcattccctattgcaatagaagcataaccagcagccattacgtccgatcctaaagcagttgcttgttgccctccagaatatacattgtttcctattgcagttgtttgagaagcaaaacctacagcaccatggcctaaaatagtcatacctacaccagtagattgatcgcgattcgtattcacgcctgcagagtgagggcctattattacagacttatatacattagtattaacatctttatcatatttacgaggactattttgaacctgtgttagaagagtgttttctctaccgttttttttccaataatctgcttccctccaattttctcgtacacccgctgctccggtatttccgtccatatcaatatatgttatgtcagcatatgaaacactgctcacaccaagcatccccgacatcaacaacaccaacggtgaaaatttaaaaatgcctaaaaaattacccaaaaacacaccgcactttggtttactcttcgaactgctcgctatttggcggttgcttgccaactcagaaacggctttacattgacctgttgttacatcgtattttgttttgaagattttgttcataaattcactctctttaatcttttaaaattaggttttttattgatttattttgttgatttttttaacttttttatagttattaatggattaaaatttttgctttttaggcagattaatgaggtataaatcggcgatgccttgctttttaagacaaagcagaaaaaggcgaataatactttcgccgaaaggttgaggttgaaataggtgatttttaagatattgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcattttattcctgtgatatgtaatgtacaaataatatatcgagccgattattctaacctaaatattatgagaaacaaaaggattttttagttaaatctgatttgatgtaagaaggctttagtgcgttcatgttgtgggttttcaaataacgtttttggcgatccttgttccacaataatgcctttatccataacgaccactacatctgccacatctaaagcaaatttgatttcatgcgtgactacgaccattgtccaaccttcgttagcaagccctttcatcgtgtttaatacatcttgaactaattcaggatccagtgctgaggtaggttcatcaaacagcattaattcaggtcgaatagctaaagctcgtgcaataccaactcgctgttgttgcccgccagaaagttggtgtggatagagattagctttgtctattagccctactttacataataatgtttccgcttcttggcgtacttcatcaggcttgcgttgttgtacttgaacaggtccttccatgatattttctaatgcggttttatgtggaaataaattatattgttggaataccatgcctgattttttgcgtagcggtaaaatgtttttgcgaatgtgtttgtccgtaaaatcaatatacagcggattttctttgtgaaattcgattgtgccttgttccggtaattcaagggcatttaaacaacgtaaaaaagtcgttttacctgaacctgatggtcctaagatgacaacaacttgacctttttctatatctaaatcaattccacgtaatacaggattattgtcaaatgttttatgaatattacgaattttaatcatcatttatccttggttagcgagtaacataacgagcaagttttttttctatgcgagcttgccataagaacaagataaaacagaaacaccaataaatcagggctgcctcaatataaacgggtaagaaatcgtaagacatatttgctacttgttgtgccactcggaacatttccgttactgttactaccgaagctaaagaagtgtctttgaataaactgataaatgtattactcagaggtggaacggcaacacgaaatgcttgcggtacaataattcggcggaaagtttgcatataagtcatgccgattgtgtaaccggcttcccattgtcctttggggacggattgtatcgccgctcgtaccgtttcagaagcataagcaccgacatttaatgagaaaccgataattgcggcaggaataggatcaataaaaatccccagtgcaggtaatccataaaaaacgatggatatttgcactagcattggtgtcccacgaataattgaaatataaatttttgttataaataaaaagaggcgatggataatgctatggcttggactcactcgaattaacgcaacagcaatcgcaataaccattcccaatataaatgatacgatagcaagcggtattgaaactaataccgccgctttgaccatgggaaaaaatccattgatgactaattctgctcttgcctcagtcataaaaggcaatgaggcaaggaaattatttaacactgatatctctaccaaagaattgttcacctaattgttttaatgtgccatcgttgcgtaattcttcgatagctgcactgatttttgctagtgcttcatcattatttttattgacaataagacccgcacccactttatctttagattcccataccggttttaaacctgaatttgggtattttttcaaataatccaataaggctagtgcatcgttaaacgtcatatctgctcgtttttgttgtatgagtaataagccttgtgccatgccgtcaataggaacaatcttagcttggtatttttgtgccaattcaccatagtttgagctaagtgtttgtgctgcttttaagccttttacatcttcaacttgtttaatgcgagtttcattatctcgtgctactaacattgctccggaccaactataaggttcagatttgtcaaaagtggcttgacgttcaggtgttgttaatgcgacttggtttgctaccaaatcaaaacgtccagcttttaaaccagcaagcatcgcatcccattgtgtttctttaaattcaacggttacacctaattttttagctactgcacgagtcacttcaacatcatatcctgtcaattttccggttgagtcgtggtaagtgaacggtgcgtaagtgccttccgtaccgaccgtaatcgttcctttgttgttaatgcgatctaataaactcgcctgtgctaaggcttgtgtgttggcgactattgcaaaaacggtagtgaataaaaatgttatttttttcaacataaaagctcctttcagtaaaaattgcgttgcggtaaaaaagagtgcttggcattgtaaaagaaatgttaaatattacaaataactttcgggaatatgttatgcagaatgggtgtttttatgaggcgatgaaaaatgatccggattcaacgcctaaagcttaagctgaaaaattagtaagcgagtaaaggaaaatcaagcgatatttcgttatataacttgaaataatactgaataatagctatattacgacaaagggcgtaagctgccacaagtgctacttaatcgggcgtaagctgccataagtgctacttaattaggtgcaagctaccgtaagtgctgaagaaaagatgcctaacggcatcttttttttgctcaaattctcatttggaatatgacgatgaatgacaaattaaaactatatcgtgtaacggatcactatcttgattttttaagagatgttgagcctaaaatcccaatgaataaagataatggaaaaaaacgcccttttgttggcattgttctttccattaacggcgtaaaatatatcgcccctttatcttctaaaatttgcaaaagccaaagcgattttaaagtgaaaagtggcggtgaacaaaaggcgactattcgatttgcgtatatgttccccattgttgatagtgctttaattgagattgattataccgaagaatttaaaatagattttaaatatacggcattgctcatcaaagaggacttatacatcaatcaacataaagcacgtattcacgaaattgcaaccaaaacgtatactaatgcaatcacaaaacgttttgggtttgaaaatttctgttgcgactttgcaaaactggaagaaaaacatcgagcttatgaagctcagtaaaaattgctccagtgtatctgctagggatgtttttatagaaagtatatttagaacaatgggttagattgaaagtgcggtgttgttttggtggttttgataaaaaaatgagctttgataagtgaattaggacttaaaaaagctcattttgttatatcgaaaaggtcaatgtagccagaataaataagcaaatgtaccgataaacagtacacaaataatattcaagaccacccctgctcgaaccatttctttttgtttaatttcgcctgtaccaaagacaattgcattcggcggagttgcaaccggtaacatgaaggcacaagaggcacctaaaccaatgatcaatgctaaacctaattcaggcatgccaagtgaccgtgcaatagaaatgaagataggaactaataacgccgcacttgcactgtttgaggtaaattcagttaagaaaatgataaaggcggcaactaataaaccgataagatagaagttcccaccttcgatcatgaagactatgccgtcagccaaaactttgctcgcacctgagtcttgtaataccgcacttaatgttaaaccaccaccgaaaagcattaatacgccccaatccgtattatcttgtaactgtttccaagaaattacgccactgacgcaaacggcaatagcggcaagtaatgcgatgacactgtcaaaactggcaatatttttttccaaccctaataaagatgacagcattgggttgagtttggcactaaatatccagcaaaatgcaatagttacgaaaatgagtaatgtaatgatccgttgattattcatctcaactttctcaaagttttgtttgaaactcgctttgagattcggtttaaagataatgtaaagagtaccgatcatgattggcataagaataagcatgataggtaaaccgaaatagagccaatcggagaaagataatttcaattgagaagcaacaattgcgttgggcggactaccaatgacagttcccataccgccgatactcgcactgtaggcaatacctaataagacgaatacataagtgttatgttctttcgttctatctaattggctaagaatacccatagctaacggcaacatcatcgaagctgttgcagtattactcatccacatagaaagaaatgcggtaattgagaaaagataaatgacgccaataaagagatttccttttgccagcatcattattttattggcgatcattctatccaatttttgaatatgcagtgcggtagcgagggcaaatcctccaaagaaaaggaaaatagttggtgctgaataagaagctaaagcggtttttgttgtgactaagcctaatgcaattgctataaacggcaccaataaggctgttactgttacatgcagtgcttcagttagccataacacagcaataaagactaataaagccagtcctttatttgctttttcatcaaagggtaatacataaagtagaacaaaaaaaacgataacatcaagaatgaatattaacgcattttggttaaaaattgatttagaaactgttttgctcataaggttatcctgcttagataaaatagtgaactatccctatttggtggtaggaatttgagtgaaagttaccaaatggtaaaaaaaatgcaacgaccttttgttttttttgtgaggtatgtctaaaaaataaaaagtgcggtcttttgcaccgcactttttgtaggaattaatgctgaatggtgattataagctatcaaactcttctaaatctaaaggctcttgagaaagaataatgccggtaagatctgcataaatatagtcatcaggaaagaaggttacgccaccaaaatttaccggaacgtccgtttctcctatgctttgttcatctgaaccgacagggataggtgcaagtgcttgaatgccgatatttatgttttctaattgttgtaattgacgaattgctccgtatacgataatcccttcccagccattatctgccgctaattgtgctaagtttgcatcaattaatgcacggcgaaccgcaccgccaccatcaattaatagcactcgaccttcgccattttcttcgagaatttcactgattaatccattgttttcaaagcatttgattgtggtgattttcccaaagaacgtgcttttgccgccaaaactggaaaaaataggctcaacaacatcaatttgatcgaggtaaatatcacaaagttcagcagtatcaatatacatagggttttccttctatatttcggacagttgttaagtataaccaatattagtttacaagcaagctcaaactgaataatagattcgtgaacaaggcaagtaaggacatttgtgcaagcattgggcgtaaatgtaacggatttttattgcgatacacaaaatgtgcatgcttgatcagcagtggaaaagaaagaataaagataaaatttgaccaatgtgtaaatgtgtataaggcaaaaataatataacttaatgcactgagcaatagaataatgcaatgataaatacgtgcattctcagcccctagacgtactacaagggtatttttacctgcttttctatcttgttcaatatcacgcaaattattgatatttaataccgcagtagctaataagcctgttgcggtagcagggagaaaaataagccaatttagctgatgggtttgcagataataagtaccgccaacaccgagcagaccgaaaaatataagtaccgaaacatcgcctaaacctaaataaccataaggttttgtacctacggtataagtaattgcagcaagaatggcgagtaaacccaaaagtgcaaaggcaacaagatcaacaattgtttgataagcactcacaatcagtaaactaccggaaattaaactcaagaatacaacaagaatcagtccttgttttaattgttttgcgttaatagcaccttgttgaatagcacgcaacggtccgatacgttcttgtgtatcggaacctttttgatgatcgccataatcattggcaaagttggataaaatttgcaatagcaaggtcgttaataaacaaagtaaagttgttgtccaactgaactgttgtgaccaataagccaatgctgagccagtcataattgaggcggcagccaaaggtaaagttttgggtctagctgtttcaaaccacattttgacattattatttgccataatatccacattataattgatacagaaaatgaaattttcaccaagcgtgtaaatttgcgttattctactgttttattaatgagtttttaactgttttaaggaaaatatgtctaaatttttacttcatcttacgccgattgcaatcattcatacgccgtataaagaaaaattttccgtccctcggcaagcgaatttagttcaagacgggacaggtattgtggagttgcttccgccgtttaattgtccggaggctgtacgtggactggagcagttttctcatttgtggttaatttttcaatttgacaacgtgccgacaggtaaatggcaacctacagtacgacctccccgtttaggaggtaataagcgtattggtgtttttgcttccagatcgacacatcgccctaatcctttggggttatctaaagtggaacttcgtgaagttgaatataaaaacggaaagattttgttacatctcggttcagtcgatttgattgacggtacaccaattttagatattaaaccttatattgcctatgcggataatgaacctaatgcaagatcgggatttgcccaagaaaagccaaagcaggaattgcgagtggaatttagtcctgaggtgcaggcaacactggaaaaactggaaaaaaaacgaccgcacttgaagcgttttattcgagaagttattcagcaagatcccagacctgcctatcagaaaggaaagtgttttcataaaatttatggcattgcactgtatgaatttaatattcgttggagaattaaaaatgatgattttacagtggcggaagtgatcgaaattcagaatatttaaacttcaaataaattttttgatccgcttataagtgagatgtttgtggagcatgctgtgttggcgaaagaaattagagaaaaatccgcaaattcataccgcacttgctcgcttgttatcacactttttatggctacaaccagaaaattgcaaaaaatcaggtggattttaccgctcacataactatttttcatttgtaaaaatgtaaattcaaaaaaaatttcatttgaaaaagtgtaatcataatcataaaatcgaccgaaaatcagaaatcggacaacataatgaaacgaacaattcttcacgcattgcaaaaatggaaagagaaaccgaaccgtaagccattgattattcagggagcaaggcaggttggaaaaacgtgggtgatgaaacattttggtgagcaggcttttgctaaggtagcctatatcaactttgataacaacccccgaatgaaaagcctgtttgccggcgattatgacattcaacgcctgcttttagggctgaaaattgaaagtggagtagatattcaggcagaagatacactgattatttttgatgaaattcaggaagcaccacaagcactttcttcgcttaaatatttttacgaaaatgcaccgcagttttacattatggcggcgggttcgttacttggcgtatcgctacatcatcaagtctcctttcccgtcggcaaggttgattttctgcctctttatccgatggatttttacgaatttttaaccgcacttggcaagcaagatttagtggaactattggaattgcaagactggatactgatttctgcgatgaaaagccgttatatcgatctgctcaggcaatattattttgttggtggaatgccggaagcggtcaaaacctttgttcaaactcaaaatttagatgaagttcgccaagtgcaacgcaatttgttgatggcgtatgaacaggatttttccaagcatattcaagacggacatacagtgcaacgggtgcgggcgttatggcacgcaattcccgagcaacttgccaaggaaaataaaaaatttgtgtattctctgttgcaaaaaggggcaagaagtaaggattatgaacttgctcttcaatggctgaaagatagcggtttggtgcatttagtccctcgtattaaaaagcctcatttgccgctttctgcttatcaagatggtgcgtttaaattgttcggattggatgtcggactattgacggcacaaactcatttggataaaagcgttttattggaaggcaatcgcctatttactgaatttaaaggtgcactaactgaacaatatgtacttcaacaactgattgcaagccaagagaatccggtattttattgggcgacagagcgaggtaccgccgaggtcgattttgtactgcaatataaacaagcggttattccgattgaagtaaaagccgaagaaaatctgaaggctaaaagtttgaaagtctatgttgaacaattccaaagcgaaaaggcaatccgattttcaatggcggattaccgagagcaggattggatggtgaatgtgccgttgtatgtggttaaaaatatgttttttaaaatttaaaggcattttatttatgcataaaatttatggtatggcactgtatgaatttaatattcgttggagaattaaacatgatgatgatgttacagtggcggaagtgattcacattcagcatgtttgatcttcaaataaattttttgatccacttcacatttttacagttttcttttttctttttatgaatttttccattaaactactttttgtttaatcgaaacgtttcgatgataattatcaatgttttctctgaataatttcagaaaaactggagaaaattaatatgaagaaaacaaaattattaaatgcgagcttatcacattatattgcaacgttaggccatacagacagtttggttatttgtgatgccggattgcctatttcaaatcaagttgaacgtgttgatttagcgttggaggcaggcgttcccggctttttacaaactgttgatgtggttataagtgagatgtttgtggagcatgccgttgtggcgaaagaaattagagaaaaaaatccgcaaattcatgacgcacttttagattcgttaagaaaattatcagaacaacaaggcaactgcattgccgttgaatatgtggaacatgaagaatttaaagtattaagttctgagagtaaagctgctgtacgtacaggggaattctcgccgtatgctaatattattttgtattcaggtgtgccattttaaccagttgaagagaggtatttatgcaagtggaaaccttgctcaaaattaccggtgtagataaatcttttccgggtgttaaagcacttagtaatgcttgtttatctgtttatgcgggacgagcaatggcacttatgggagaaaatggtgcaggtaaatcaacgttaatgaaggttttaaccggaatttatagcaaagatagcggttctattgaatatttaggagatgttgtcaattttaaaggacctaaggattctgaaacggcaggaattagtattattcaccaagaactgaatttagttgcaaatttaaccgttgctgaaaatatttttttggggcgtgaatttacaacctcttggggtgcaattgattggaagaaaatgtacagagaggctgataaattattagcacatttgggtgtgtcatttcgcagtgatcagctttgttcggaattgtctattggtgaacaacaaatggttgagatagcaaaagcgttgagctttaaatcaaaagtgatcattatggatgagccgacagatgccttgacagatacggaaacggaaacgctttttaacgttattcgtgaattaaaagaacaacattgtggcattgtatatatttctcatcggatcaaagaaatttttgaaatttgcgatgatgtaacagtattacgtgatggacagtttattggtgaaagtgcggtgcaagatctcacggaagagcgtttaatcgagatgatggttggccaccgtttagaggagcaatatccgcatgttgaacaagatcgtggttctgttcgtttggaagtaaatcagcttttcggtagcggaatatgtgatgtgagctttaaactatatagtggtgagattttaggtgtgtcaggcttaatgggtgccggtagaactgaattgatgaaagtgctatatggtgctttgcctaaagaagaaggtgaagtgcggttaaataataaagtcatttctaatgattctcctcaagacggtttaagaaacggtattgtatatatttctgaagatcgtaaaggcgacggactaattttgggtatgtctgtaaaagaaaatatgtctttgaccgccttggatcatttgtcaaaagccggaaaaattaatcatcaagcagaaaaaatggtggtagatgattttattgagttgttcaatattaaaaccccaaaccgtgaacagcaaataggcttgctttctggcggcaaccagcaaaaagtggcagttgctaaagggctaatgactcgtcctgatgtacttattttagatgaaccgaccagaggcgttgatgttggtgcgaaaaaagaaatctatcaattgattaataaatttaaacaagagggattaagtattattttggtttcatctgaaatgccggaagtacttgggatgagtgatcggattttagttatgcacgaaggtcgtattagtgctgaatttagtcgtgaagaggcaacacaaggaaaattacttgccgcagcactcgggaaacataattaagggaattgtatgaaatcatcatttaaattgggaaaaatgttattagagcaacgttcagttattgctctgttgatacttattgctattgtatcaatgattaatcctgactttttcagtattgataatattcttaatatcttacgtcaaacgtcgataaatgcgattattgcagtaggtatgacttttgtaattttgattgcagggattgatttatccgtcggttctattcttgcgttgaccggtgcggttgccgcttcattagttagcatggagttatccatttttatggttattccgttaacgctattattggggacttttttgggtagcgtaagcggttttatcgttgcaaaaggcaaagtacaggcatttattgccacattagttaccatgactttattacgtggtgtgacaatggtttatactgaaggtcgtccgattagtacgggattttctgaaacggcagacagctttgcttacttaggtacaggttatttattgggtattcctttgccgatttggttaatggtaattgtatttgcggttgcttggtatgttttaaaacactgtaaaatcggacgctatatttatgctttaggcggtaatgaaaatgcaacgcagctatcaggcataaatgttaatagaattaaaatatttgtgtttgcagtgagcggttttttatccgcacttgccggattgatcgtcactgcacgtttatcttcagcacaaccgacagccggtgtgtcttatgaattagatgcgattgccgccgtcgttgtcggcggaaccagtttaatgggcggtaaaggtcgtgttatgggtacattaatcggtgcattgattatcggttttttaaataatgcactgaatttattagatgtttcatcttactatcaaatgatagcaaaagcgttggttatcttaattgcggtgcttgcggataactatttaggtaataaaaaagcataaactcaatatctttataggagatttcaaaatgaaaaaattaacaactattgcatcagctgtcatgttaagtcttgcttttagcggtgtagcaatggcaaaagagacaattgcattagcagtgtcaactttagataacccattttttgtatcacttaaagacggtgcacagaaaaaagcggacgaattaggttataaattagttgtgttagattcgcaaaatgaccctgcgaaagagctggctaatgttgaagatttaatggttcgtggtgcaaaagtattattgatcaatccaacagacagcgaagcagtttcaaatgcggttgctattgccaatcgtcgcaatgttcctgtcatcactttagatcgtggagcggcaaaaggtaaggtagtgagccatatcgcttcagataatgtagctggcggtaaaatggcaggtgactttattgcacagaaattgggtgcaaatgcaaaagttattcaacttgaaggtattgcgggtacatctgcagcacgtgagcgtggcgagggtttcaaacaagctattgcagaacacaaatttgacgtattagccagtcagccggctgatttcgatcgtactaaaggcttaaacgttatggaaaatttattagcaagtaaatccgcagttcaagctgtatttgcacaaaatgatgaaatggcattgggagcgttacgtgctattaatgcggctaataaaaaagtactggtagtcggttttgatggcactgatgatggtgttaaagctgttaaaagcggtaaattaggtgcaactattgcacaacaaccggaacttatcggtagtttaggcgttgaaactgctgataaggtattgaaaggtgaaaccgtcgcagagaaaattcctgttgacttaaaagtcattgttaaataataaagtgagggcatatttattgccctcatttcttgatataaacaataaggacgattttgtttattttctgataaggataaatgatgagcaaaactcttactgttctcggtagtattaatgcggatcatgttatttctgtaccgcactttgccaaaccgggcgaaacactaagtggtaaacaatatcatattgcttatggcggaaaaggtgcaaatcaagctgtggcagcagcaagattagcggattttagccaaggtgcaacagtgaattttgttggttgtattggtagtgatgatattgggcgagcgatgaaaaaagcgtttgcacaagatggtattaatgttgcgacaattactgaaattcctaatgaaatgactggaattgcaatgattcaagtggctgatagcggagaaaacagtattgtcatttctgccggtgcaaatgcatatttaacgcctgagattgtagataaatttgcgacagaaattgagcgggcggattatttactcatgcaattggaaacaccgttgaacgcaattttggaagcagctaaattagctaagaaacatggtgcgacagtcgtattaaatcctgctcctgcgaaccaattacctgatgaattgctcagtttattagatatgattacgccgaatgaaacagaaacggaaattttaaccggtgtgaaggtaaccgacgagcaaagtgcggcgaaagcagcgagtgttttgcatcaaaaaggtgttgctactgtgttgattacgttaggttcaaaaggtgtttatgtgagtcggaaatcttcgacacaagaactggggcagaataaggttatagccggattcagagtaaatgctgtagatacaactgcagccggtgatacgtttaatggggcatttttgaccgcacttttagaaaataaatctcttgacgaagcgattcgttttgcacatgcggcggcagcgattagtgtgacgcgtcaaggggcacaaccttccattccaactcgtcgagaaacattagactttttggcacaacattaattaatgtaagggcgttgaagatggctacaatgaaagatattgctcgaattgcacaggtatcaacgtccactgtttctcatgtgattaataattcacgttttgtcagtgaagaaattcggcagaaagtcatggcggtagtggagcaactgaattatacgccctcagcattggctcgcagtttgaaagtcaaagaaactaaaacaatcggaatgctggtaactacgagtgataatcctttttttgctgaggttgtggcgagtgttgaacgttattgtcgccaacatcattatcatttgatcttatgcaataccaatgatgacagtatttgtctgcaagaaaatctgcaaaatttgatacgcaagcaggtcgatggattgctcttgatgtgtacggatagtgcctttgaaaccagtcctttaaatttaactgttcctactgtcatcatggattggtggccgacagagctgagtgcggataaaatttttgaggattccgagcagggcggatatttggcgacacggactcttattgagcatcaacatcatgatattgcgattattacgggaaatctgaaaaagcctcttgctcgtaatcgtttgaaaggctataagcaagcgttgcaagaatacaacattcctattcgtgataaatggattattgaaagtcattttaactttgaaggcggaattaagggaatggaacagttgttacaattgaaacagcgtccaagtgcggtgtttgcttgtagtgataccattgcagtgggtgcttatcaagctgtttggcgtcatgggttatctgtgcctgaagatatttccattattggttacgataatattcatttagcacaatatctttctcctccactaagcaccgttcatcaacctaaagatgaattcgcacacttggcagtagatacattgttgcaacgaataaaaaatcctaccgaaagttaccgcacgttgacgttaaaacctgagatagtattgcgtcaatctatttgttcctgttttttgcctaagtccgcatagaaaaaagaccgcaagtgcggtctattatttatctccaaaatttccaccagcttgtgcgttttgcttccggaccttgaatgattgtattattgatatattctttttcaacatcaggtagcggtttatctaaattaacgtcggtgacaataccgcgtcgatcaaaattcacaataaaagtatgttgctcaggtgcattataagatttttgttgtaaaaatacgtagtaccaagtttgattgctaaatggatctattagcattggcgtaccaagtaagtactgaacttgttgtgcattcatgcccactttcacttgttctacagcggtagattctaaatagtttccttgtggaacatcaatacgataaacgattttttgaacactggaacaagcggtaacgcttaatcctaaaatcatagcaggaataataaattttaatcgcatattttgtttaccttaactcgtgcaaataacgtcgtggataataactaaaattcgtaaaattgccaacttattcttttgtttggcgttgtagttgatcgcgtaaattcggcggtagtcctgtaatggttaaactatccgttgcttcatcccaaaatatacgactgtttaataactcggcatcaaaacttaatgtgataccttttcctgagccggaaaatttagtcaacgattttaatgcagtacgtacgggaggaatattttcttctaagccataattttggctgacagcgaaatcaacaaaagactgttcatttagagtgggtatattggcggaaagttccgtgacaacgatttcttcgcctacatttatttgtcctttacaataatcgaatacttgttttttgaccgcttgagtttgttcttttgtcaaatccgcctgttggcagtagtcactaactgcttgtaataaacattgattttgcacttgaggatttaatccctcttctgcacctaaaaaatccataaaaaagtcagcaattttgcgtccaactcgacctttaataaaagtcagataacgagttgattttgcatctaaatgcaattcggttaaattaattcggcaagcaatatcaaattgagtaatatcaagataatgcgtttgttttatttccagattttcatcaaccaacatactatagcgactatctaataatgcgatgaataaataatctgttgcgagaaaattgtattgacacaaaattaacgtgccatcattggcaaaactgtattttcccaactcttgacgtaataattcggctgattgatgactaaatgccaagaaatcaatatcgttttccaatgtgcggttgagtatttgagcaaaatttgaggtttcttggaatactccataggcttttgttttattttgatactcttgatgtaattgcaacatcatttgttctgtttccgctgtaattggtaataattcatcacgtaaatgcgttttaagttgaacggtattttcatcttgtgatgttttaaccaattgatgcaaaacaatttgattgactataatgctcattttgttcaaatcctgtttatgataaaaattcttaatattataaccgcactttaaggaaaatatgctagtatgtgtccaaattattcgtttctatttatctttagcgtacaaaattaaatggcaaaaatttcaaaatttcaagataaacaagttgaggcaatattgaatgatatgatcgctgtactggaaaagcatcaagctccggtagatctttctttagtcgtattgggcaatatggtaacccatttgttaaacagtagtgttgggtcgcaacaacgtattgtgttggcaaaagtattttccgatgctttaatgaattcagtaaaaaatagtaaataatatgtttggaattaaaacaagcaagcaatatcgtgatgaattatctcgtaagattacgtggggacattggtttgctttttttaatattttgtgggcaattgttattggtagtcgttatgcctttattattgattggccgcatactttattcggtaaaatatatttttttattagtttattggggcatttcagcttcattgtttttgctctctatttgctcgctctctttcctctcagttttattataaaaaatgaacgcacttttcgtgggataagcgttattttaacaacgataggtgcaaccttactgttggttgatacagaggtgttttctcgttttaatttacatctttcaaccctcgtttggaatttgttggttaatcctgatgatggtaagttatcttataagtggcaaatattttttgcacctatgccattgattttatttgttcaaatgcttttctcacgttgggcatggtataaattacgcagtttagagagacaaaaatggattaaaggtgttgctcttgtatttgttgttagctttattgctacacatattctttatgcttgggcagatgcgtatatttatcgcccgattaccatgcaaaaatcgaatttccctctatcttatccaatgacagcacgttcatttctcgaaaaacatggtttcttaaataagtctgaatatgaaaaaaccttaaatgagcaaggtcgtcttgatgcgttaaaagtgaattatccaaagcagaaattaactttttccgatgagttgccaaagacgaatattgtccttatcaccattagtggattacgtcatgatgcagttcgacaggatataatgcctaatttatttgcattttctgagaattcaactgactttactcatcattacagttcaggaaactctcttaatcaaggtttgacaggattgttttatggattgaatgctaattatgcggacagcttacttagcaataaaacaacacctgtattaattgagcggctaaaacaaggaaaagtgcggtatgaaatcggtctatttggtcagaatttatctcgaagtatattattgaagaaaagtatttttgcaaatgagaaaataagaaatgacaacaatacctctacgcggcgttttattgagtttgttaatactcgacaacaacagcaaaaattattttttgcctatctaaattattcactgaacagcaatttgactattgaacaatattatcaaaagttatctgaaattgatgatgagattggttcggcatttaagtcgatagattttactcataccattgtgatagtgacttccgaatatggttatagttttgatttttctgataaaaaaagaccaactaattattttgcaagagaagtaattcaagttccaatgattataagatgggaaaatttacctatcggtaaagtgaataaattgagtagtcataccgatttggtaccagccttaatgaaacatatttttaaagtaaaaaatccaattagcgatttttctcaggggcaggatttatttgatttggatgataatcgtagttgggttcttgctggtaattaccgttggaatgtaatcattacaccggatgattcgcaatatcatattgataggaatgggcattatcaaaaatacaatcaacattatcaaaaaatttcgtcaacacaacctccgttaggattattcttagaagtattttcacagaatacggctttcatcgaaaaatagatttattagaggtaagccgtttttcgagatgagaatgctaagagtggaagcgtattctgttttataaaaaaaagcgtttcttttgtgggggaagaaacgctgaaatgttggagtgattatctattattgtttgagtgatatagatgataattgttctcaaatagcttgtcaacaaataaataaaaattattatcaattttttttcttgtctttaattattctaggtaactcactaaatttgttagataaagtgcggttggtttttgatgagaaaaatcaaatttcacggcatagctataaacttcaacaccttctttaactgcttgctgcagtaattcggcataatcaggatcaatagattttgcaacggtgaagcgattaaaaccgtcgtgaagacctgcgaaaaaaacgaccgctctatgaccccgttttttcattgctataagctcacgcaagtgtttttgtcctcttgttgtgacggcatcagggaacaaaccgagatgatttttgacaaacgtaacggattttacttcgacataacaatccggtaagtttttacctttgagtaaaaaatcaatgcgactattttctacaccatattttacttcaggcaaaatctcatcatattcagctaattctgtgatgattttattttgcaaagcctctaaagttaattgattggaacggtgagtattgatacataccgtttgaccatttttaagttgagttaattcccaagagtgcgggtattttcttgttttgctgtcagaagtagaaaaccaaacagtatcgcctttttcaccacatcctgtcatcgcaccggtattggcacaatgaagcgttaaaatttcaccgttgtttaattctacatctgccaaaaagcgtttataacggcgaagtaatgttgctgattgtaaattcggtaattgcataaaaatccttgttatccaacagtttcagtaattttaccagctttatctgaaaaaaatttggattgaagcaatagttgaaatttttaagaaaatagctttatttttagcgaattaatggtacatttactccgcttgactttttgtcatcttaaaggatgggcgatattatctcccaatttttttaatcaatcaatttgaaggaaacattatgttaattggtgtacctagagaactgcttgataatgaaagtcgtgtggcggcaacgccaaaaacggttcaacaaattttgaaacttggttttgaagtgattgttgagaacaatgccggttttaatgcgagttttgaagatcaggcgtttgtaaatgcaggcgcaaaaattggttcggcacaagatatttggaatgcggatattatttttaaagtaaatgcaccgacagatgctgaaattgcacaaattaaagaaggtgcaacgcttattagctttatttggcctgctcaaaattcagagctaatggcaaaactttcttctaagaaaattaatgtgttagcaatggatgctgtgcctcgcatttctcgtgctcaagccttagatgcgttaagttcaatggcaaatatttccgggtatcgtgctgttattgaagctgcacatgaatttggtagcttttttacagggcaaattacagctgcaggtaaagtacctcctgcgaaagtacttgttattggtgcaggggttgcagggcttgcagcaatcggtgcagctaatagtttaggtgcgattgttcgtgcatttgattcccgtccggaagtaaaagaacaagtgaaatcaatgggagcggacttccttgaaatagatttccaagaagagggcggtagcggtgacggttacgcaaaagtcatgtcagaagaatttaatcgtcgagcgatggcactttatgcggaacaagcaaaagaagtggatattattattaccacagcagcgattccgggtaaaccggcaccacgcttgattactaaagaaatggtggattctatgaaaccgggtagtgtgattgtggatcttgctgcactgacaggcggaaattgtgattatacgcaagccggtgaaattgtggtaactgaaaatcaggtgaaagtcatcggatatacagattttccaagtcgcttaccgacgcaatcctctcaactttacggcacaaacttggttaatttattaaaacttttatgcaaagaaaaagatggcaatatccatattgacttcgaagatgtggtattgcgtggtgtaaccgtaattcgtgatggcgaggttacttggccggctcctccgattcaagtgtctgcacaaactcaacaaaaaataaccgcacctgttgtggataaaaaagaaaaaacgccaataaatcctaaagtgaaatatggggtaatggcactggcgggagccgctttcctatggctcggttctgttatgccggctgcatttttatcacactttactgtattcgtattggcttgtgtggtcggatattacgttgtatggaatgtaagtcatgcattacatacaccattaatggcagttactaatgcgatttcaggcattatcattgtaggagcattattgcaaattgcacaaggaaatttctttatcagtttgttggcgttcattgctattttggttgcggcaattaatatttttggtggctttaaagtgactcaacgtatgcttgccatgtttagaaaaggttaaggagaggatgcaatgtctgaaggtttagtacaggctgcctatattgttgcagcattactgttcattatgagtttagcaggtctttctaaacatgaaactgctaaagccggttgttggtatggcattgttggtatggcaattgcacttgttgctaccatttttggaccatattcacaaggattattctggattattattgcaatggcagtcggagccgtcattggtattcaacgtgcaatgaaggttgaaatgactgaaatgccggaattggttgcaattttacatagttttgttggtttggcggctgtattggtcggttttaatagtttcggtttacatgaaaccgcacaatttttggtaccggaaggtgttgaatatgtcacggacgctgctcaagcattattagcacaacaaaaagcggactttgttgcggaacaatctgtattggcaactattcacaatgttgaggtctttttaggtatcttcattggtgcggtaacatttaccggttctattgtcgcattcggtaaattacgcggtattattaattctaaagcgttaatgttgcctcatcgccataaattgaatttggcggcattgattatttctgcgttgttgatggtcgcatttttgaattcacctgataatatcttccctgtattactaatgacagcgattgcacttgcatttggttggcatcttgttgcttcaataggcggtgcagatatgccggttgtcgtatccatgttgaactcttattcaggttgggcggctgcagcggcaggcttcatgttaaataatgatttgctcatcgttaccggtgcattagtaggttcatcaggggcaattttgtcatacattatgtgtaaagcaatgaaccgctcttttatcagtgtcattgccggtggattcggtaatgatgtagttgcttcatcagaggcagaacaaggtgaacatcgtgaaacaacagccgaagaagtggcggaaatgttgaaaaatgcaagctctgttattattacaccgggatatggtatggcagtggctcaagcacaatatccggttgcggaaattacagcaaaattgcgtgaacgtggtgtgaatgttcgctttggtattcaccctgtagccggaagattgccagggcatatgaacgtattgcttgcagaagcgaaagtgccttatgatgttgtacttgaaatggatgaaatcaatgaagattttgcggataccgatgtcgtattagtcattggtgcaaatgatacagtgaaccctgccgccatggatgatccgaatagtccaattgcaggcatgccagttctagaagtttggaaagcggctaatgttgtcgtattcaaacgctctatggcggtaggatatgctggtgtacaaaatccgttgttctttaaagaaaatacccaaatgctttttggtgatgcaaaagagcgagtagaagatattttgaaagcgttataacaagagaaaaactggtatagaatataactgcactttgctaaaataaagtgcagttatttttttacatttaggaatatgttatggtgcaatatgccttgctcattttgtttagccttgcttcaataatttttattattaactcccattatcgttggacatatttttttgcaataagtcaatttttgttatttattggcattatgtttactattacagggcaatggcaaagagcggttaatttttcttctacattattcattgtttttgtgttgtttcatcgaattaaaatccatttttataagcaaccgcttttgatttcagatttctttttagtcatagattggcgaaattgggaaaccttgttgcattatcgtcaggctttttttgctattatggggctattggttttgttggcttatggtatattcggttggcaaaatacccccgctcttcctttttattggcagataatatcaggcttaatttctattattttaattgtttcaatttgtcattgtacaaagaacaagcaagctatcaagcaatggttagattctttacctgatgatggaagagatgtatttcttaatttacctatgtcctgtcgaggaatcttttataaatcgccggtattttctggaggtagtcaatattttcttgaaaaagcagaatcaattgaaagccataaacaatcaaattcggagcaaaaagcagatattgtagtttggttacaagaatcaacgttaaatccgcatagttttctttttaaacagcacaatattccacctatcacaatgtatgaaaatcaagatgatacaaaatgtaattctcatctgcgagtacataccttaggtggtgcaacttggaaatcagaatttgcatttttatcaggattgccctcaacagattttggtgcaatggctaatgcagtattttattctgtcgttcctcatctaaaatacagttttgttaaaaatttaaaagcacaaggatattattgtgttgctctatctccttttactaaaggaaactataatgcgaaatctgcctatgatcattttggttttgatttaatgttacaaccgcaagatttgggttatccggctcccttaagtaagaatttatggacaatcggtagtgatgaaatgagtcagtatgttcagaaaattcttgataaaaaagatgtgcctcaactaaaagatttacaaaaccccttatttgtttatgtattaacaatgcgtgaacatggtccttattacaactgcggtaatatttttcaaattcaaatggattgtgcaacggagcgagggatcggggaattaaatgattatattcaacggattgtaaatttgaatcaagttatggaagattttaatctttatatgcaacggagaaataagccttatattttaggttattttggcgatcatcaaatttcaataaaagaagctgtaccaagttacagttttaattatccttatccggaatatatcacgcaatttgcggttcgcagtaatttagaaacggattttgaaaagcacgattttttagatttagcatttatagcaggagctattttagaaatagcgggattgcctgtcgatgaatttatgcaaacaaatattaaaatgagaaaattaagtggaggtaagttacaggactgtactgatcaacaattattagagtcttatcgccattatatttattcagaattaaaagtagcggagtagtttattatgaatatgttgcctaattaaaggcgttgctattaaaaggtgtaatgaaaaatggttgctaataatatctttctgaagttattagcaactctttttatttaaaagtccttattgacgtcctcccctagctaaagcaaggagattcctaccagctcccattgcaagcaatgggctactctcggtggtttctgctgctgaccgccaatgcgattcacttcacagacgctacaggcatgtcctgccctgattatgccgtcattgagagtctaaagcgacctctgttagcagtaagaagtatatcatatttgtgccttatatctacgccctaaaggacgtggttttacggcactgtctgataaaaactattttttcttcgcatatttcaaggaatcaattgcaacggcaaagataataattgaacctttgataatatattgccaatatggatttacaccaatataggttaaaccatagttgatgacagtaaaaattaatacaccggttactacgcctagtacagtaccaacaccgcctgcaaaagatacaccgcctacaacgcaagctgcaatggcatcaagttcatacataaaacctagattgttggtggcagaaccgatacgtcccgcttctaacatccccccgaaagcgtagaatatacctgcaatcatgtaaatgacgacaaggttacgagtaacgttaacacccgatacttttgctgcttccggattaccaccgatagcgaaaatgtttttaccgaaacgtgttttattccatagtacccatacaaagaaagaagccaaagctgcatagattgtaatataggaaagcttgaaagaacctatacggaaaaagccttgagcaaatgtagagaaactttcgttgaaccctgcaataggtgaagaaccgacagcatcataatagagagagttaataccgtaaacgataatcatcgttcccatcgtggcaatgaaaggtgtgacatttaagaacgcaatcacaaccccatttaccaatccaattattgccccaatcacacaaactactatgattacaacaggaataggaatttcaccaagttcagggaaaactctatttatattatccattgcctgtaacagagttgccgaaataactgcagctagaccgacttgacgacccgctgacaagtctgttccttgtgtaactaataaacctgcaacgcctaaggcaataattaagcgaacggaggattgcgttaaaatattactaaagtttcttaaacttaagaaacttgagtcttgcataataataattccgagtaagatcaataacacaaaataaattgcgttttgtttaaggaaatctagcgatttgttttgttttaaagcagacataattcatttccttcctttaaagatattttgccgcaagttgtaaaatttcttcttgcgatgttttagctgtttcaacaatttcagtaacttttccgttactcataactaaaatacggtctgtcactcccaataattccggcatttctgaggaaattagaatgatccctttatctttttttgccaattccatgattagctgataaatctcgtattttgcaccaatatcaatgcctcgagtcggttcatcaagcatcaaaatttcaggttgtgtgagcaaccaacgcccaataattactttttgctgatttcctccagaaagtgagccaatatgggtttgatgtgaaggggttttgacattcattgcatcaataacccattgggtatcacttttcattttaatggactttaataaaccaaaatgacctaaataggatttcatattagaaatgagagagttaaattctatgctcagatttgcataaatacctgttgagcgacgttcttcggtaacgagagcaaatccattattaatcgcctcaagtgcggtgcgatttttcatttctttgttatacaatttaattgttccacttttacgctcacgaataccgaaaatggtttctacaatatccgtacgtttggcaccaacaagtccagcaataccaagaatttcacctttatgcaattcaaaagaaacatcttgaatggagggttgatttaatgctgtcagatttttgacttcgagaataacttctttgggttgatttgttttagggggaaagcgttgagttagttctcttcccaccatcatggaaactatttcatccatggtagttttttgtacttcaacagtattaatccatttaccgtcacgcaaaattgtgatttcatcacaaattttgaaaatttcatccattttgtgtgaaatataaacgattccacagccacgtttttttagttttgcaatgattttgaataaatgttcaacttctttttctgaaagtgaggaggttggttcatccataatcacaattttggcattgtaggaaaaggcttttgcaatttcaaccatctgcatttgtgatacagataaattcgctactttctctttgggatcaatatcaatacctaactcatcaaaaatagcttttgtatctcgatacatttttccgtgatcaacaaaaatgcctttcaatggatagcgtcctagccataggttatccatcacattacgttgacgcaccaaatttaattcttggtgaaccatggatataccgttttccaacgcctcttttgaggttttgaaattaattggcttgtttaaaaaaagaatatcgccttcatctttagcataaataccgaataagcatttcaacagtgttgatttacctgctccattttctcccattaacgcatggactgagtgagatcgaattgttaaattcgctttatcaagtgcttttacgccgggaaaggatttactgacatttatcattgtaagcaatatttcgctactttgatgtagagtttgtcctgtcatatccaacctcatagaaaaggggagtacatatctcccctaatgattacaacaattattttaagaattcatttaagttgtctttatcaatgccgacataaggaatacgaacaacacgtttttctaatttccagtttgttccttctgttgcaggtttaccttgtgctaaattttttgcaagttgaaccactgctttaccttggttaacaccatcatttagtacggtacctgccatttcacctttcttaattaactgtaatacttccggcaaggcatcgacaccgaaaatcgggagttttttaccatgggctttagttgcttccaatgcacccattgccataccgtcattattagaaataataacctcaatttcgtttgctttagagctggataaccaagcatccactttatcttttgccattgcagcatcccacataccagtatcaatgaacaattgttctgattgaataccctgagcattgagtgcttcaattacgtatttggtacgagcttcagcatccggatgccccggttcacctttcaataagacatattgaattttcccatctttatttaagtcataggctggatttgctttccaatgtttcgcaattaaattaccttgaatgagtccggattctttaggatccgtaccgacatagtaagcgtggttatagcttccaattgcttttgctccgggatctttattgaagaagataactggaatatcctccgattttgcttttttaatgacagttggtgcagcggcagggtcaacaaggtttattgctaatgttttaatgcccttggaaattaatacatcaacctgatcattttgaacagattgtgcattttgtgaatcattcattaacaactctaatccacctacagcttttgcttctttatcgatttcttgacgcattaacgccataaaattatcgtcgtatttgtaaatggttacaccgatacgatcagctgattgtgctgagattgcactaaaacctacagctaaagttaccgcacttaatattgtttttttcataaaatgctccttgattggactggaaaatagatattcttatcgatacttagcctatggtttggcaagccacgacaaggatagccgaaaatgtgtgacaagactgtgatctgtttcacatttatagaaatttatgaaaacgatttcataaaataggaaaattaaggacgttcaactgaaaagcgtcgaactaaagttggattaaattggatatgaacaggttcatcaatttgattgtctactagacttagtgcgagttttgccgcataagttgccattaaatcaataggatagcgtacagtagtcaacttaggaattaaatagcgtgaaatgggcatatcatcaaatccaataatagagaattgtttaggaacttgtatattattttcgttcaatacggaaatagcaccagcagccatactgtcgttatacgcaataactgcggttaaatttgagttataactcaataaattaatcatcgcattttcacctccttcaaaatcaggtgtgctacgtgcaattgcatgttcaacagcgtgaagtttatgatgttctaatgctttcaaatagccattaaaacgatcattttcatctgtaatttgatgatttgagccaatataaccaatatgctgatgcccaaatttgatcagcatttctgtagccagaaaggtacctttattattgtctaaacttacacaacgagtttcataaccttgaatgacacggttgatgattaccataccggaaatacgttctaaatattgagcaagctcttgatcacttaaagcttttgaatgaacaactgcatcgtttgcacaataaggtgtctattgcatttctttctttttccgcattgtgatagccaatgccgattaagatacttttttcatgttcttccgcaacgttatctacggctttaactaaaattgcaaagaaaggatcggttacatcagtaacaacaacgccgatagtatctgtatgttgtaaggcaagagcttgagcattggcatttggatgataatttaatttttcgaccgcactttgaaccgctaggcgtgcttttttactggcagaaggatgattattgagtacccgagaaactgtcgcaacagaaactcccgcttgtctagctacgtcatgaattgtaatcatcttattcacccatacggtttaaaatttgcatgaattgccacttatcataaccaaataaattatgtttggaaacggttgttaaactaaaataaaagcgacttcacaaaattattatttatctcaatatttataatttaataattgtgatatggatcacagttaaacaaaatagcgatgtgatagcatagctgaaaattatttgtaatcgtttacatttttgcgataaatatcaagtttgagggtataaaagtgagtgaaatgaccgaatttgttgcgacagaacatccgcatcgtcgttataatcctttgacggaacaatgggttttagtctctccgcatcgagctaagcgaccttggcagggacaacaggaaaaaatagctgatgaaaataaaccttgttacgattccgcttgttatctttgtccggggaataagcgtattaccggtgagcaaaatccgaattatacgaaaccttttgtgtttaaaaatgatttttccgctttattggaagatacgcctgaaccactaaaaacggatgaccctttatttcaatccagtctagcacgtggcgaaagcagggtagtttgtttttctccggatcatagtaagacgttgccgttattaacggtagaggaaatttttgcagtggtaaaagtttggcaagaacagctggaggagcttggtaaaaaatatcaatgggtacaaatttttgagaataaaggtgcggttatgggctgctctaatccgcatccacatggacaaatttgggcaaatagttttttgcctaatgaagttgctcggacagacaaggcacaacgaaattacttcaataaacaaggttcggttttgttaatggattaccaaaaacgtgaacgagatttgcaggaaagagtagtaattgaaacggaatattgggttgcagttgtgccttattgggcggtttggccatttgaaatattgttactacccaaaattcacgtgaagcgattaattgatctgaatgagacgcaggcaaaggatcttgccttggcattaaaaataatcacaaccaaatatgataatttgtttgaaacttcttttccttattctatggggttccattttgcaccttttaatggtgaaaagaatgaacattggcaacttcatgcacatttttatccaccgctactccgttcggcaacggtgcgtaaatttatggtcggttatgaaatgttaggggaaagtcagcgagatttaaccgctgaacaggctgcagcaaggttgcgtgaattaagcgatgttcattataaaaataaataaatttaacggagtgataatatgactcaacaaaatccaaaacagcgagcgaaacaattatttagtgaaaaatttaaccgcacttctgaactgaatgtctatgcccccggacgagtaaatattattggtgaacacacggattataatgatggatttgtgatgccttgtgcaattaattatggaacggcgatcagcggagcaaaacgagatgatcatttattttgtgtatatgcggcagatttacaagaatatgatgaatttgatttaactcgacctattgaacccaaaatggaagctaaatggacaggttatgttcgaggtatggtgaaatttattcaacaacattgccctgattttcaacaaggtgcggatctggttatttgtggaaatatcccactttcagccggattaagttcttctgcatctttagaaattgctgtaggtaaattttgtcagcaactagcggacttatctttaacaaatatagaaattgcattaataggtcagcaggcagagaataaatttgtaggtgcaaattgtggaaatatggatcaattaatttccgcattgggtcaaaaagatcattttctcatgattgactgtcgatctttagatattgttaccatacctgttcctgaaaatattgttgtgatgattgtgaattctcatgtgaaacatgatttagtaaatggcgaatataatatacgccgtcgacaatgtgaaatggcagcccaattttttggcgtgaaagccttacgtgatgtatctgtggagttgttcaaacaaaaggaagcagaattaaccgctcttgatcctgaaatagcgaaacgtgccaaacatgttgtgacggaaaatgagcgggttttacaatcagttcaggccttacaacagggagatttgcaaaaattaggggaattaatgtatcaatctcatgattccatgcgtgatgattttgaaattactgtgcctgaaattgattatttagtggagttggcacaggtcgttatcggcaaaaatggtggagcacgcatgaccggcggaggttttggcggttgtatcgtcgctattgcaccgcaagacaaagtggaggcagtacgtcaaattattgcagacaactatgaaaaacaaacaggtttgaaagaagatttttatgtttgtaccgcttctaaaggagtgacgatatgctaattgattgttttgagaaggaacacaagcaaggaatggcaccggatggacaaccttttcgtatttttacgttaactaatacaaaaggcatgaaagtgcaagtgatggattggggggcaacttggatttcttgtcaagtaccggtaggaaaagaagtacgagaagttttgcttgggtgtcagattaatgattatccgatacaacaggtttatttaggagcgagtattgggcgttatgcaaatcgtattgcaaatagccgatttgagttgaatggtaaacgctatttacttaacgctaatcaacatcagcatcaacttcatggtggaaaagggtttcataatgagcgttggtatttagaaaagtgcggtgtaaattccatcactttttctcattttagccctgatggagatcagggatttcccggtaatttacatgcttttgttacttattctttaagtgaaaccaacaacgtgagaattgaatatgaggcaatttgtgatcaagattgcccaattaatttgactaaccatgcttattttaacttgaatgatgctactttcggttgtgatattcgagggcattctttacaacttaatagcgattattttttgccggtggacagtgcgggtattcctaatgctaagttaaaagcggttgagggaactagttttgattttcgtgaggaaaaaccaatcggtttagattttttacaagaagaacaaaaattggtaaaaggttacgaccattctttcttgcttaatttggacactgaaaaaccttgtgctattttgaccgcacttgatcgttctttgagaatgcaagtgttgacttctcagccggctttacagatttatacgggcaattttctatcagctacgccaactcgtcaaaacgggcagtatgctgattatgctggtattgctttggaaactcaatgtttgcctgatacaccgaatcatccggaatggtggaaatatggtggaataacaaaggtgggtgaaaaatattctcataaaacggaatatcaatttatccgttagatttttaagcaaactctattgaaattaagggggagtattcaaaaaactcccttatttttttctatttctcgcttatatttttgttatgtcatacttttcctgatttttcctagttattcgttacaaaatatgataattttcatgggtcaataagacggaaacaatattacagtttatgagtaacgacgaacagattaatacaatcacagaaaatgaaagtaagaaaaatttctttcactctttatttggacgcttttttcagggtgaattgaaaaatcgtcaagaattagtagacgttatccgagattctgaacaaaatgagctcattgatcaaaatacacgtgaaatgattgaaggtgttatcgaaatctcagaattaagagttcgagatattatgatcccacgttcacagattatttttatcgaaaatgatcaggatcttgaagcgtgtcttgatgttattattgcaagtgcacattctcgtttcccggttatcagtgatgagagagataatattgccggtattttacatgcaaaagatttacttaaattttttcggtctaatgcggagcaattcgaattacaaagtttattacgacctgccgttattgtaccggaaagtaagcgtgtggatcgaatgttaaaagattttcgtgctgaacgttttcatatggcactagttgttgatgaattcggtgcgatttcaggtttagttaccatagaagatattttggaacaaatagtgggggatattgaagatgaatttgatgaggaagatgtggcggatattcgtcagttgtctcgtcatacttatgtagtacgagctttgacggatattgatgattttaatgagcaatttaagaccaattttgccgatgaagaagtggatactatcggaggtttgattatgcaagcattcggctatttaccgaaacgtggtgaagaagttgtactggataatttgaattttaaagttacttcggcagatagtcgtcgtattattcaagtacgagttactgtgccggatgagcaacttacagacagtaaaaaacagaatacagaagaatgagaaattaccttgtttatttcattgctattttaactgggggagtgggcgtattagccttttccccttttgatctttgggcaatcgcctatctttcattagcagggttgatttggattgctaaaaaatcgcaaaaaaagaccgcacttctagccagttttttatggggtttaagtttctttgggattggcgttaattggctcaatgtcagtatttatcaatttggcggaacaccgttaattgtgagctatttactggtcattttactggcaggatatttggcactttatcctgtgttgtttacttatttagtacaacgttttagggtacaaagtttagcgatatttcctgcaatttggacattgactgaatccttacgcagttgggtatttactggttttccttggctacaatttggctatactcaacttgacagcccatttgcgaacttagccgctttgttcggtgtagaagggctgacttttttcgtgatgtggataagtgcggtcatttttagtcttatttctcagctcatacaatcaaagaaacaatgggcaattattattacacatagtgtattgcttgttgtgatgttagggctaagtacatccactgcgttacttaaatttacacaagaaaatccacaaaaatccctaaatgttactttagtgcaaggaaatattgaacagcaactaaaatgggatcctgattatttttatcaaacactcactatttaccaacgcttaattaaccggagtttagatgactcagatttaattatattgccggaagctgccttgccggccttggaaaatcacattcaaccttatttgcaaaccttacagcaacttgctcaagaaaaaggcgttgaggttgtaattggaacgatttatcaagaggaaagtgaggataaattattaaattctatcgtaaatctcggtaacgctgatgaaccttatcatctaaacacaaaaaaccgttatgcaaaacaccatttagttccttttggagaatatgttcctttagacaaaatattacgcccgttaggttcagtttttaacttgcctatgtcaagttttgcgtcaggagactttgttcaaaaaccatttttagcgaaaaatcgccattttactccggcaatttgctatgaaattatttttggttctcaactacaacaaaatttaactaagcaaagtgattttattttaactatctcaaatgatgcttggtttggcgatagtataggcccttggcaacacttgcaaatggcaagaatgagggcgattgaactgggaagacctgttattcgtgcaactaatactggtattacagcctttattgatgcacaaggtaaaatagttgcacaagctccgcaatttactgaaacgacactgagacataaaatcgttgcaacggaaggtatgactccctatgcaatattaggaactaagccgttgtatttgttaatcagtttattagtattatttagaagtctgggggcattgatacgcaaaaaattgacgcaaggatagaaaaatattattttgcgaacaggttacagctatttttccagattgtagatgcgataagttctgccggttcttttcttaattgacataattcatggaaaacatgaataattcgctctgaacgattgggttgaccttgaaaaccacaaatgggcatatcgggactatccgtttccagtaataaactgtctaaaggtaattttgcaatagtatttctggttttattggcacgttcataggtgattgtgccgccaacaccaattttatagcctaaatccacaaaacgctttgcttgatcataacttccggcaaaaccatgaattacaccgcacttatttacttttattcgtttcagaaaagtgaataagtggtcgtgagattggcgactgtgcaagctgacaggcaaattaaagcgttgtgcaaaactgagttgaacttctagaaattcacattgctttttccataatctctcgctaatcagatcagattttcctcgttccaaacctatttcagcaattgctgtacaagcagcagaaccttgttctaacgcttgggacaaaatatctaaatcatttttactatgctgttcaatatataaaggatgtaagcctaatccataatacagctgagtcgggtaaagtgcggtcatgtttacaatattttcaaaatctcgctgcaatactgcaacaatcagcattttctctaccccaattcggtgagcattatgtatgagttgagctaagttttcctgggtaacttgctgtacataatctaggtgtgtatgggtatcgaaaaaatgcataatgatttgatgctggcaatttgaggaacaatattggctacattacgacgaaatccttgatctactttttgttgaatgatcaaggaaatcgttatctacaagatgggtaaaaattgtaatatgcttgaatgtaacaccgcactttttgatgaaaatgtaccgacaatatttgtcggtccactatcaaaaatattattcaatggtaacagaagtaataattacatcttcaacaggcacatcttggtgaaaacctttgtttcctgttttgacacctttaattttatcgacaatatccattccttcaacgacttcaccaaatacagcatagccccattcttgcacaacggttttaccaaacatttcttttgctcgataatcaaggaatgtgttgtctgctacattgatgaaaaattgagctgtcgccgaatgaggatccgatgttcttgccatggcaattgtgccacgtttattgctaagtccattacttgcttcgtttttaattggtgctttagtatttttttcacgtaagccactttccataccaccaccttggatcataaatccatcaataacacggtggaaaattgtgttattatagaaaccctctttgcaatatgttagaaagttttccgctgtaattggtgctttttcaaaatttaatgctaatttaatatcaccaaaatttgtgtgtaatgtaatcattttagatcctttgattttgtgttgttataatgatgcttattatttcataaagttgcaataagtgctataaaatcatcactgagcggattcagcgttctggtagattaacgatttcatttaattatagagaacaaacaaatgttaaaaatttttaataccttaacacgagaaaaagaagtgtttaaacctatttcagaaaataaagtaggaatgtatgtctgtggtgtaaccgtatatgatttgtgtcatattggacatggacgcacttttgtttgttttgatgttatcgctcgttatttacgttatttaggttatgaattgacttatgtgcgtaatattaccgatgttgatgacaaaattattcgccgtgctttagaaaataaagaaacttgcgagcaattggtagatcgtatggttgttgaaatgtataaggattttgatgcgttgaatgtattacgtccggattttgagcctagagcaacacaccatattgcagaaattattgcactggttgaaaaattaattgcacgtggtcatgcttatgtggcggataatggtgatgttatgtttgacgtggaaagtttcaaagagtatggcaaattatctcgtcaagatttaacacaattgcaagcgggagcaagggttgaaatttctgaaattaagaaaaatccaatggatttcgtgttatggaagatgtcgaaagagaacgaacccagctggaattcgccatggggagccggtcgccccggttggcatatagaatgttccgcaatgaattgtaaacacttaggtgagcattttgatattcatggcggtggggctgatttaatgttccctcatcatgaaaatgaaatcgcacaatcttgttgtgcacatggaaaccggtatgttaattactggatacattcaggtatgatcatggtggacaaagagaaaatgtctaaatcgttgggcaacttttttactattcgtgatgtgttaaaccattatgatgcggaaagtgtccgttatttcttgttgacagcccattatcgtagccaattgaattatagtgaagaaaatttggatttggcacatggtgcattggagcggctatacactgctttgcgtggcacagataaaagtgcggtttctttcggaggggagaatttcattgctcagtttactgaagctatgaacgatgattttaatacgccgaatgctatttctgttttatttgaaatggctcgtgaaattaatcgattaaaaaatgaagataaactgcttgccgatggcttggcggctcgtttaagagagttagcgagtattttaggtctattggatcaggatccggaagattttctacaagcaggctcggatgatgctgaaattgctaaaatagaagaattgatcaagcaacgtaacgatgctcgtcaggcaaaagattgggcgagagctgatgctgcgagaaatgaattgacgacaatgggcgttattttagaagacagttcaaacggaaccatgtggagaaaaatgtagtgattgaaatgggcgatattctcgcccattttgatgcgttacggttagattttacttatcagcagaataatataatttaccaatctcaattttctgacgaccatttgcttcacgccatttgtttgtatctcgtaaagaatagacgcaaccgcagtattcttgttggtaaaaacgttctcgtttactgatttcaatcattcgttgcgaccctccgcctttacgccaattgtaatcccaataaaccacatcatcatatttttccgctgcacgatgtccacaaccattaatttggttcatatctttccaacgagaaattcctaagcaactagtaaaaacagggaaaccattttcatgggcatactgtgcggctttttcaaaacgcatatcaaagcacattgtacaacgaatgccccgttccggttcatcttccattccttttgcacgatcaaaccaattttgacgatcataatctgcatcaatgaaaggaattccccatttctcggcgaagcgaatattttcttctttacgaattaaatattcttttaacggatgaatattgggattataaaagtaaattgtaaaatcaatgcctgaagcatgaatagcttccatgacttctccggagcaaggtgcacaacaagaatgtaataacagtttattatgtccatgtggtaattctaatttgggacgtacgaaaggtgtattcgaatttttacattctttcttacgacgcttttgtgcatcaaagtgcggttgcttttgttcaagtttggttctgtgcatatctattttcataaggcttgtttgataacgattaaatttaggggaataaatgtttaatttccccactcaagtctaaaaggtttttcattcaaatctgataagtatttttactacaatactcaatgtctaatcattaatagtgcctctcaacggataaataagccaaagaaattaatgcttgcttatattggttttctggtaaacaggaaattgaatcaacagctttttgtgcctcttcttttgctttactcatggcataatccaaagatttttgctctgtcataatggcaagtacatcatccaaaaaatcccgttttccgccctgttcgattgcttcacgaattaatgcagattgttgtggtgtaccattacgcattgcatgtaataaaggaagagtaggtttcccctcagctaagtcatcaccgatatttttacccaaagtcgccgcatttgcactgtaatctaacacatcatcaactagttgaaatgctgttcctaagtatcgtccatagtgttgtaaagcaatttcttgttctgcattactttgagctgttatggcggcacattgtgtagcgacctcaaacaagcgagcggttttactataaatcactttcatataattatcttcacttgtctccggatcattgacattcattaattgttgtacttcaccttctgcaatgatatttgttgcatcggacataatttgtaaaatacgtaatgaattgagtttagtcatcaattggaatgcacgtgtataaataaaatcacctaccaatacacttgccgcattgccgaattccgcattggctgtcggattaccacgacgcatatcggactcatcaacaacatcatcatgtaacaatgtcgccgtatgaataaattcaacaaatgcagcacaagtaataggttcatcaccttgataatttagtgctctggctgctaacaaagcaatcatagggcggatgcgttttccaccactttgaacaatgtaataaccgagctgattaatcaaagcaacatccgaattaagttgtgctagaattgtggcattcactttatccatatctgttttaataagagattggattgcatggatattcattgggttcattttttctatcatgctgaaactatcataaattaagctaaaagtgcggttgattgtacctgattttctgagctttctgaaattaaactctataaaataagatttttttattttcttaaaaagaaaggcttgcgaagaagccgtttttttcgtagaattcgcaacctatttatatgaattttgatgtgctaaatgaaaataacattataagcactattatctagcggagtatttatgtacgcagtttttcaaagtggcggtaaacagcaccgtgtaagcgaaggtcatgttgttcgtttagaaaaacttgaattggcaacgggctctactgttgagttcgattcagtattgatgatcgttaacggcgaagatattaagatcggtacaccagtagtgacaggtgctaaggtagtggctgaagttgtgtcgcagggacgtggcgaaaaagttaaaatcgttaaattccgtcgtcgtaaacacagtcgtaaacaacaaggtcatcgtcagtggttcacagaagtgaaaatcactgggattcaagcataatttcacaggagttatagaatatggcaactaaaaaagctggtggttcaactcgtaacggtcgtgattctgaagctaaacgtcttggtgtgaaacgtttcggtggcgaatcagtattagcaggtagtattattgttcgtcagcgtggtactaaattccatgcgggttcaaatgtaggtatgggtaaagatcatactttgttcgctactgctgatggtaaagtaaaatttgaagttaaaggcgagaaaagtcgtaaatacgtttctgttgtagccgaataattttattgatacagagtgatgccccacaatgtttttgtggggttttttgtttttagaaaattaatactttattagcacagttaccagtgcggtgctattattgcacgagttttgtatttatataggagggcgaatatgaaacagaaaccattactcgggtttatatttgcattgactactgcgatagcttggggatctttacctattgcattacaacaagttatgaatgctatgagtatgcaaactatcgtttggttcaggtttatggttgctactgttgcattagctattttacttaaattagcgaacagattacctaaattatcagatctcaatcgttacttttttggactggttatattaggtgttatagggctatctggaaactttagtctgtttaattcctcattaaaatttattgagccttctgttactcaaatttttgtgcatttttcttcctttgcaatgatgttctgtggagttgtgatctttaaagaaaggttaggattacatcaaaaaattggtttagttattctaattattggacttatcttatttttcaatgagcgagcggaccaattatttgatattaatatctattctataggcgtatttttaagtatgtcggcatccttgatttgggtaacttacggacttgcacaaaaattacttttacgccgttttaactctcaacagattttattgatgatttatacagggtgtgcatttgtttttactccttttgttgagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttaggagaaaaaaatgaaatttattgatgaggcactgattcgtatcgaagctggtgatggcggtaacggctgtgtaagttttcggcgagagaaatttattccgaaaggtggtcctgatggcggtgatggcggtgatggcggtgatgtatatctaattgccgacgagaatttaaatacattgattgattaccgatttgaaaaaagctttgcagcagagcgtggagagaatgggcgtagttctgattgtacaggacgtagaggcaaagacattacattaagggtaccagtcggaacaagagcaattgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattggaattaatgcttttagccgatgttggtatgttgggattacccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggggcttctgaaggtgctgggttgggagtacgatttttaaaacatttggagcgttgtcatgtcttaattcatttggttgatattgcaccaattgatgagagtgatccagcggataatattgcaatcattgaaggtgaattatttcaatatagtgaaaaattagcgaataaacctcgttggttagttttcaataaaattgatatactttcagatgaagaagcaaccgcacgtgcaaagaatattatgcaacgtttgggtggggaagatgattattatttgatttcagccgcaacaggtaaaaatgtagacgttttatgccgcgatattatggattttattgaagaaaatccacgtcaagaacaagaaaagatagatgctcaagaagtgaaatttaaatgggatgactatcatcaagaacaattgtccgaacaggtctttacagaagatgaccaagaagaggatgattgggacgattggtcggaagacgatgaggaaggtgtagaaattatttataaaccttagctacagaataaaatatgagagtttccttttttatttaaattgaatgttgatattcatattctaagtaggaaactctcagtttttgtagtaagttgtctgagcaatgctgatcttctacagatatatcaccataaaatatctacttgtttttagtgatgagcggttatttttcctacatttttttcgtaaaaaagtaaatagagaaagattgtttttttaatcagtgtttctgcatcagtaactaagatgtctcttcctctaagttattgaaatatctttgccaatcaaaatattgaccagggtctatttttctattcggagatatgtggcaatgtccgacaatacgttgtttggttattaaaggatatgaatgcataatgtctaaagtcagacgttctaaagattgatattgttcttctgtaaacggttgaagatcacttccttccaattcaatgccaatagaaaaatcattgcatttttctctcccttcaaatgaggataatccggcgtgccaagccctatcattgaaattgacatattgtgtaatagcaccatcacgagtaatcaaacagtgtgctgacactcgaatgtttgcaatagttgcaaaataagggtgtgcgagaggatcaaggttacctagaaaaaaatcatcaatatacgaaccaccgaattgctctggcggtaagctgatgtaatgaataactaaaagggaaatatcactattttccggacgttgatcaaaatgtggagagggtaattttctagcctctgaaaaccaacctgtgcagatatttttttgtttattgttcataaattattatttttgcgagtcggctcgcagaaaaagtgcgatttagttgtcggtttttttcaatttctacaaactttcacttgccattcggcattgtcattttatttaaaaaaggaaacattatgaaaataacctatattttttcatcagttaaaaaaggatttactctcatagaactgatgattgttattgctattgtggcaattcttgcaaccattgcaattccgtcataccaaaattatacaaaaaaagctgcaattacagagctattgcaagcttcagctccttatcgtgcagaagttgagctatgcgtgtataacaatgatgcaccgacaaattgtaatgctggaacaaatggaattcaagcggcaatcaatacaccaaaaggtaaagtaaaatcagttagcgtgcaaggtggagccattactgttacagggaatggaaatcttaaagatattacttataccttaacaccaacaggcgatgcttcaaccggcgttacttggagtgcaaattgcaataataaggcggatctatttcctgccggattttgctcttctacgtctacaaactctccttaaaccattaattacggtgggttgtctcaccgtttcatattaattgcactataaaaagaatttttttgcaaaaatattgcatatttattcaaacagtgataatgtttgcgtaaatcaattaataaccaaaacgagatcttttattcaaatgacaattagtgttaaaaatttaaattttttttatggtgcatcacaggcactgtttgatattaatctcacagctgaagatggtgataccgttgttttattgggaccaagtggtgcagggaaaagcaccttgattagaacgttaaacctacttgaagttccaacatctggagaattgagtattgccaataataaattcgatctctcgcaagatattgccaacccaaagcaaatgcgtcaattgcgtcaagatgtaggtatggtatttcaacaatacaatttatggcctcatttgactgtaatggaaaatcttattgaggcaccgattaaagttttagggatagcgaaagaaaaagccaaagaacaagctattgaattattaaaacgattacgcttggaagaattcgctgaaaggtttccactgcacttatcaggaggacagcaacagcgtgttgctattgctcgtgcattaatgatgaagccgcaagttttattatttgatgaaccgacagcggcattagatcctgaaattacagctcagattgtatcaatcattcaagagttacaggaaatgggcattacacaagttattgtaacgcatgaagttgcggtggcaaaaaaggttgcaaccaaagttgtctatatggaacaaggtcgcatcgttgaaatgggggattccagctgttttgaacaaccctcaacagagcaatttaaacaatatttatctcactcacactaatatttaaggagcttattatgaaaaaattacttttagcaacaatgttggctggtgctacgattggtgcaaatgcacaagatattacttttgctatggaaccaagttatccaccatttgaattaactaatgaaaaaggtgaaattattggttttgacgttgatattgctaatgcgatttgtaaagaaattcaagctaattgtagcttcaaagcccaagcgtttgatgcgttaattccaagtttaattaaaggtcgcggtgggtttgatgcggcaatttcagcgattgatattacggaagctcgtgcaaaacaagtagcatttaccgattcttattatgaaagttctgccagttttattgcattaaaagggaaagcggatttaacgacggcaaaagtggttggtgtacaaaacggtacaacgtatcagcaatatgcgaataaagaagcgaagcaatatcaatctaaatcttatgctagcttacaagatgcaattttggatttaaaaaatggtcgtattgatctcatttttggtgatacggatgtattaagagatatgtttgataaaaatccggaattgcagtttgtgggcgagcgtgtaacggataaacgttatttcaataacggcttgggaattgcggtaaataaaaagaataccgcacttgttgagcaattaaataaaggtatttcggcaatcaaagcaaacggcgaatatcaaaaaatttatgataaatggatgactaaataattttatgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggtttttctaatttattttggcgtacctgaaatactggaatgggtaatcggagaatatgtagagtttggtgcctttggttgtggcgtggttgcactgtctattatttttgcttcttatgcttctcaatctttgcgtggagcaattcaggctatacctttaggacagtgggaatccggtgcagcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacttaatgcgtcaagctgaattaatcaacaccaatactcaccaaccttttacttggtatggatttgcagcattgctttatttgttgattacgctatttagtcaatttattattcgtaaacttgagcggcgagtcacacgctttgaacgtgctacaaattaaaggatgaaaaatgattaaagattattttttaacaattgcacaaggaattccaacaagcttgattcttactatagttgccttgttggtagcattttttcttgctttgacattaacttttgctctttctatggaaaaaaaatggttaagtcttccaattaatctttttctcacaatttttaccggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatttctaaaggacaatgggaaagctgtgttgcactaggtttgagccgttggcaaactttgaaaattcttgttccttacgcattaaaaagagcattaccttcatatagcaatgaaataattcttgtttttaaaggtacatcacttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaaatacacaataacaaataccgaaaagtgatctgtgccttaatttatcgtttatgagttatctatttaagatttaaggaacagatcaatatcggtaatcaccaattgctatttcgtatgaagttttgccaatccgatatcacaacttttgatttgtatatcatgctccatggcgagaatttgttgcttactttgttttaatttactttttatttttgccagttgaacatgtgttcccggctgtttttctgcctcagcaattagattttctgtttctttaaataatttttggcactgctcaggcagagtgtttgcttggacatgagttgttgttatagttgcaaatacgctagctaaaataatcattactgatcttggttttagcattatattcattgataacctcttgaaattttttcagaaaaccttcggaaactatcaaaaaaagactgacatgtctagttatttattgcttcatatttttttgtaaatttttactatttggaataaatgttaaaaattgtgaatattctataatgtttgatgtatatcaatatataagaaagtgttaaagaaatgttatttgatttagatctaaaaatgtgatctttataacacttttattgttttttattcttacttttagtagtaaaattaataccgtttttgggttatccacatgacatttaatggtgaactgtgaaacttatgtaaattttatgttgtatgttcatttaaatgaatgtttatgaggatagttcagtaaatctacttgaggtttcaacttgagtatttgaggggtggttacatagtaatcattgtgaaaaacttgtagcattgcacaaggagttggagatgttggacgttgttgaactctctagattgcagtttgcgttaactgcgttgtatcactttttgtttgtaccgctaacattgggtttgtcatttatccttgtgattatggaaactttatatgttgcaacaggcaaagaagtgtataaagatatgaccaaattctggggtaaattgtttggtattaattttgccttaggcgtgacaactgggattacaatggaattccaatttggtactaactggtcatactattctcattatgttggtgatatttttggggcaccgctcgctattgaagcattacttgcatttttcttagaatcaacatttgttggtttgtttttctttggatgggatcgtttatcaaaagctaaacatttattaactacatattgtgtagcatttggttctaacttttcggccatgtggattttagttgccaatggctggatgcaaaatccggtagcgtctgagtttaattttgaaacaatgcgtatggaaatgaccagttttatggatctttggttaaaccctgttgcacaaagtaaattcttgcatacattgtctgcgggttatgtgactagtgcatgttttgttttagctattagttcatattacctcctaaaaagacgtgatgtcggattcgcaaaacgctctttctctattgcatcagttttcggtatcattgcaactgtttcagtattgatcatgggtgatgaatctggttacgaaattggtcaaacccaacctgtaaaattagctgctatggaaggtgaatggcatactcaaccggctcctgcgtcttggaatatgattgttgtacctaatcaggcagagcaaaaaaatgattttgctttacaaattccttatgctgcggggattattgttactcgctcattagacaaacaatttacaggactagttgatctacaagctcttaatgagcaacgagttcgtaacggtatggttgcctatggtttactacaacaattgaaggctgagaaaaaggccaacggtcaggttaatgaagaaactaaagcacaatttaacgcagttaaagatgacttaggatttggtctattactcaagcgttatactgatgcggtcgtagatgcaactgatgagcaagttaagcaagcagctgctgatactatcccaaatgtaggaccaacgttttggtcattccgtataatgatgcttgccggtggtttaattctagttctgatgattgctgcattcgtacaaaatatgcgtaaaacagtagggcgtagtccacttttattaaaagctttattatgggggcttccacttccatggattgctatggaaagtggttggttcttagctgaatatggacgtcaaccttgggctatttatgatgtactaccggttggtgtggctgcgtcaaatttaacaacagctgatctttggttatctattggactgatttgtgccctctatacaatcttcctagtagtagaaatgtatttgatgtttaaatatggtcgcttgggtccgagttcgttaaaaaccggtcgttattattttgaacaattatctaaataagcaggagtctaaccatgattgattatgaatttctacgttttatttggtggattttagtcggggtactgcttattggatttgcagtaacagacggatttgatatgggagttcttagcttattacctttcgcaggcaaaaaagaagttgagaaacgtataatgatcaattctatcgcaccacattgggatggaaaccaagtttggttattgactgcaggcggtgcaatgtttgctgcttggccgatagtttatgcagcctctttctccggcttttatgttgcgatgattttagttttagccgcactatttttccgtcctgtcgggctagagtatcgtgctaaaattgataatccaacttggcgtaaattttgggattggggattatttgctggtggttttgtcccatcattggtattcggtgttgcattcggtaatttattgcaaggtgttccatttgaatttaatgatttgatgcaagtaacttatacaggttctttctttgaattattaaatccttttgcgattctttgtggtttaatcagtttttctatgttaaccacacaaggtgctgcttggttacaaatgaaaacaacatcagaactgcgtgagcgtgctcgtgtaataacacaagtaggtgcttttgttacattgttgacgtttattttggctggtgtttggttatatttcaaagaaggctttattgtaacaagtgtccttgatcataatgcaccatctgacccaactgttaaaacagttgcagttgaagtgggagcttggtttaagaattattttgatgcacctgtgttgtttattcttccagcattagcagtgggtggtgcgttgttaaatattttggcatcaaaagccaaccgttcaggatttgcatttttcttctcgtctatcacgatggcaggaattatattaacctgcggtgttgccatgttcccatttgtgatgccttctatttctcatccgaatatgagtttattaatgtgggattcaacatcaagtgaattaacattaacactaatgcttggttttgcactgttctttgttgttattttactgagctacaccatttgggcttatgcgaagatgtttggtcgcttagatgctgacttcattgaagaaaacaaaaactcattatactagtaaggagataagattatgttttatgtgttatgggtagtgggtgttttgttcgctgttatgctaagtgcaatcattactatcagtcttgagaaaacgggtaaacttgacgaataaggagttttctttatcgactgaaaaataagggcttctaaagagcccttttattttttcttttgtgtaaatttttcatgatcaaaagtaaaagtatttttaactaagcactgggtttattttaaggtgcgatgtatagtctaaaaaaatatttttcttttcattgtatttattcttgctaatatatttgactgaatctagaatacttggttcatttttcatatagaaatgagaaaataaaagactttgtgagggagagtaatatgcctgtttttaaattgcctgttcgtgtgtattacgaagataccgatgccggaggtgttgtttatcatgcccgttatctccatttttttgaacgggcgagaacagaatacttgcgaacgttgaatttttctcagcaaaacttattgaatgagcgaaaagttgcttttgttgtgaaatcaatgcagattgactactgtgttcctgcaaaattagatgacctattaattgtggaaacttatgttgtagctatcaagggagcaagtatagttttttcacaaatattgaaacgagatgatgagatcatttcacaagctgtggtgaaagttgcgtcagtggatcttgtgaaaatgagacctgtggctatacctcaagaaataaaagcagaaattaaactaaatgataacattttcggagttatgtcatgaccgctgaattagattttttagaattatttttaaaggctagtattgttgtacaaattgtcattgtcatattaatatctttttcgattatatcttgggcgattattatccaacgtagtcgcattttaactcgagcattaaaggacagcacactttttgaagaacggttttggtctggagaagatttgtataaattatatgatggactttctaatcgtcgtaatggtctaaatagcagtgagcgaattttttatgttggatttaaggagtttaatcgtctgaaacaagctaatccggatgcccctgaagccattattcaaggcagttctagagcaatgaatttaacaatgaatcgtgaagtggaagatttggaaacacgagttccgtttttggcaactgttgcgtctattagtccatatatcggcttatttggtacagtatggggaattatgcatgcttttatggcattaagtggtgccaaacaagcaacattacagatggttgccccggggattgctgaggctttaattgcaacggctattggtttatttgctgctattccagctgtaatggcttacaatcgtttaagtctacgtgtgaataaattagagcaaaattatgctaacttcattgatgaatttacgacaattttacatcgtcaagcatttggtaaaaatcattaaatgtatcaaaattctccgtactgacggataaagtgcggttcttttttcataagtttagaggctatctatgtcttatcgtcgaaaacgtcgagatattaagtcagaaattaatattattccttttttggatgtcttattggttttattgctcatttttatggcaacagcaccgattattagtcagagtgttcaagttgaacttcccgaagctgtagaaagccaaaatgtatctaaagaagataaaacgcctgttattttggaggtttcaggtattggacagtatgcactttccattggtggggagcgaactgaggggataacagaagaattagtaactcaactttctaagcaagaatttgacaaagataataacacgttatttttggttggaggggctaaagatgttccgtatgaggaggtaatcaaagctttgaatttacttcatgtcgcgggaataaaatctgttggattgatgactaatcctctttaaatataagtaggtaacacagtgtgtaatcatcgacaaaaaaatgagcttggtgccattctgctatcaatttttctgcatattttgttattaagtttgctggtattaggatctaactataataatgttgaaatcatgggaggtggagaaggtgatggtgaagtaatgtctgctgttatggttgatacgggaaccattgcaaaagagtggggacgtttacaggaaaagaaaaaaagcaatccggataaacaagaaacctttgttgaagcaacgcaagaagacgagttaatggagaatgttgatgtatttgaagaaaaaataagagaagatgaagatgtacagaaaagacttgcagagcaaaaaataaaagaagaaaaaattcagcaagagcgtttagcaaagcaattggaagaagataatgccaagaaagagactgttgcaaagttgaaagcagaggctgaagaaatgcgtttacaggcattggcaaaaaaaattgaagaagagaaaaaggttagagacgctgaggaaaaacaaaaagtagagaagttagcgaaagagagagcagagaagttagcaaaagagaaagcggatagattagccaaacaaaaggcacttaaggaagcaaaaataaaagcggaaaaagcggctaaagcaaaagcggaattagctcaacgcaaagcggaacaagcggcgttagatgattttttcaatggaggtgatattgcaggaagtagcaaaaatggtggaaatatgacgatgaaaggttctcaaggagtgggggctggttttgaaaacggcaaaggcggaagaactggagagcaatatgctgctcaaattaagagagaaattcagcgtcgctttctaaaagaacctaggtttgctaataaagtttgtgttattgaggttgaattagcaagagatggaacgatcactaactttagaaaattatctggctcagatgatatttgtactgcggggttatcagcggtatctagaacgaaaaaggtaccggaggcaccaactgatgagatttatagaaaatataagaaatttccactcgaatttagattgaaataattaaagaaactaaaaggtaaaatttatatgaaattttctgcatatttaactacattattcatagtgctttttagtttgttcatacaaaccgtacaagctgaaagtgaggtaagaattgtcattgatgaaggggttgatagtgctcggcctattgcgataattccatttaaatggaatggtagtgactctatgccgatagatgtagctgatatcatttctgcagatttacgcaacagtggtaaatttaatcctattgcagtcagtaaaatgcctcaaaaaccgacatcagcaagtgaggtgatttccgatgtttggtcttctttaggcattgatgcagtagttgttggacaagttacacccaatgaaaaaggatatagtatcgcatatcaattagtagacactatcggtgcttcaggaaactcgggagaggtactaagtcaaaatcagtatgctgtaccgaaaaatgctattcgtttaggtgctcataccatcagtgatgaagtttttgaaaagctgactgcaattcgtggtgcatttagaactaaaattgcatacgttgtacaaaagaacggtggctcaaaaccttatcaagttcgtattgcagattatgatggacataatcaatttattgtttatagtagttcgcaaccattgatgtctcccgcttggtcgcctgatggtagtaaattggcttatgtatcttttgaaaatcgtaaatctcaattaattgtacatgatttacagtctggagctcgtcgggttattgctgcattccctgggcataatggagctccggcattttctcctgatggttcaaaaatagcatttgcttcatcaaaagatggtgtactaaatatttatgtcatgaatttaggaaacgggactatttctcagttgactagcggtgcaggcaacaatacggaaccttcttggtcaccggatgggcaatctataatttttacttcggacagagccggcggacctcaaatttatcagatggatgtagttggtaatggtgtatcattagtttctgctggtcgagggtatagtggaaaaatctctgcagatggtagtatattagtgatgatttatggcgataatattgttaaaaaagacctggcgacaggtgtgacggaaatgttaagctctactttcttagatgaaagcccaagtatttcacccaatggaattatgattatttatagttctacacaaggtctaggaaaggtgctacaattggtttccgctgacggtcgttttaaagcacgtctaccaagtagtgacggtcagattaaatttccagcttggtcaccatatttaaataaaaactaggagaggttaatgaaaaactttgcaaaattattagtagtagcgggttcagtggcagtattggcagcctgtagctcatctgataacgcatctaaaacaaatgctcaaatgtttggcggttattctgtaactgacttacaacaacgttataatacagtatattttgaatttgatagttatgatgtgcagggcgaatacgctcaaatcttagatgcacactctgcatacttaaagtcaacaccagcttctaaagttcttgttgaaggtcatgctgatgaacgtggtactccggagtataacatggcattaggtttacgtcgtgctgatgcagtaaaaaactttttattaaataagggtgttcaagctagtcaactttcaaccctttcttatggtgaagagaaaccggcagagttaggtcataatgaagctgcatattctaagaaccgtcgtgctgtatttgcatactaatttcttaagccgggtatgatgcccggttttttattgcattttttcagtaaattttgaatttaagtaggtatatttgttttaaatgcctcttttctgccgactattcgttcaaataaacaaaaaataaaaaaattttattgattattaaaataaaaacagtaatatatccgctcgttacaaacaatgagggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccattttatttataatatcccaatttgtgggtcgttagctcagttggtagagcagcggacttttaatccgttggtcgaaggttcgaatccttcacgacccaccagtcatgtttaaagattcattcataaaaatattggttattcttatttatcgtgtcttttctgtttgtttctcttaagaggacatatactcaaaattagtcacttttctttttactaaattctatttttgcgatctgtatcgtaattttttttaattatttttacccatttttctagatgagttaaagtgcggtcaaaaataggaaaaaaaatgaaagcattaaaggggtttactctattagaaatattgattgttttactgattatcagtatgacagtaacattttcttttcccatgtggcaaacagcaaatacaaaaatgattttagaaaaagagcaaaataaactctatattttcataagggagctacaagctcgagttgaaaattctaatgatatttggtttttaattgctaatcgtgatttagtgagtaagcgttggtgcctggttgcacaaccaaaaaacacagatatatgtgattgtttaaatcctcgcagctgtaatagaaatattccgatgaaattttattatccttattttgcagataaaaccatgttaatcagcaaagtttattatcctagagaaatgactagattaaatggtacaaggaatacaagtacgacgacttgttttgtgttgcaatctgatcagcaaagaacagtattttcgttttttaatgtaggatctttaaaacttaaaggttaccaatcgttaagtgcttgcgtgaatgatcattagtaagggggaacattgattatttatcgtggacaaactttattaagtgtaatgatagcgttgagcttatcaatgatgttattaatgagtgttagtgcattttatagttatagtcagcaacaaaataaacagatacttttgcatctctatttacaatcagaattgcaacgaactatccaacttttgggtaaggatattcgccgtagtggatttagggctattagtgataaattggttcggagtaatttcgatttatttgcacaagataaaagcggaaagagtattgtagtcgctcaagctgataatgaacccccgaatagttgcgttctttttatttatgatcttgatgctaccggctgtgtaggtacgacatatcgtaataatgtttgtgtaaggaataaacaaaatacagctcgtgaaattgagcgagagttatttggttatcgcttaaataaacaaatgatagagacaagattaacttataaaaattcaattagcgcgaattgtaatcaaaaacaatgccaaagctatttacaacaacctgcatgtaatagcggaggatgggtcgatttattagatgaaaatgacatagccataactgcattaaaatttaattggattgctgattacaatggattggaagtttatctaaaagggcatctaaagcgaaataaacaagtcgaatatgagacttcagccattattcctttgcttaatcaaaagagataaaaatgaatatacaaaaaggagttgtaacgctcaccctattaatgctgttaagctcagtattattaattttacttttttttgatggtgatttgatttcgttgcattcatccattgtttctcaacggaaaatatatttagaacaaagtcttatattacagagacaaagtatttctcaaaaagaaaaactttgtgaaaaccagcctctgaataataatttgaaaagtttgaagatcgaatttgaaagtcgacgaaaaattgaccgcacttctcaatttatatggtgtgaaagaaaatatttgtttaaaaaaaggccgaaaaaagctacttatgaggcagggctaagtcagtatataaatcttgagttactggatttatttcaacataaattacattcaccgcctgctattttgccgagagataaagcaaattatctctattgggttgaggaaaaatcagctgaattggagatacaaggtaatattaatgcagttgttattgctgaaggggatttgaagttaacaggaaaaggtaaaattagtggaacggttattaccggcgggaaattaagtattgaaccagcagttaaaattgtgtatcgctcaaaaacaatcatcgatcttatccgatcatatagttattggcagtttgcggagaatagttggtatgattttcaaccattataaatttcctcaacggggtaccagcttgatcacgttattagtcacaatgatgatattttctacattatttttatttgttaatcaatgggttagttatcaaagaaaaagtgcggtaaatatttatctacgttatcaagctttgcaaatcgctgaaaatcaacatcaacgcttatttctagaaccgcattttcattgtccgcataatatcgagcaaaatggttataagtttaagatcaattgtgaaggtaagaatgtacgagtttcttatgcaaatcaacaagtaaatttattgcttgattaattattttgaaaagctatgctaaatgaagttattagaagaataaggaacatttgtgtttactttgtattattccaatcaattggaaacgcaaaaagatattttgttacatttaatggatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttatcgcaagtcacagcttcttctcaatttagtaaagaaaatatgacttggcgattaatggaaattattccgcattatatagatcaaccggaattttacatattgcgtcaatatttacagcaaagttaccaatcaagtcagcagcgatactaccaattagccagcaaaatagcagagttatttgaccaatatttagtttatcgaccggaatggattataagttgggagcagaataaaggcgtagaaattattcagcaaattcagtattaccaaaaaaatttatctgtctcagaatcatgtttttctcaagttgagcaacatattgtttggcaaggtattttatggagagctttagtatgctctgtgcaaaaagaaacacaaaagaatgttttacatcgtgcacatttacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgcttgaaagtacgagagcgtataagttggcaagatttccaacaaccacaaaatacacaggcttggttatccgatgcgcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaacattgttgtcgcaagtacaggcacgcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccgtatattcaggcggtattcagtcaaggcgaacactatattccgtactctatcgcagacagcaaactttccgaaaatgaccctttagtatctgcttttttacagctgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcaacaagaaataagtgcggaggttatttacgaagtttttgttgaacgcttaaaagatatacccaatagcctaaaatttttaatggggaaagtcactttttgtacgcttctccccatgcgatcaatcccttttaaagtggtgtgtttacttggtatgaatgatagtgattatccacgtcaacaaacaccgaacagctttgatttaatgcaatatcatcgtaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatatcaatgctcaaggtgatctaaaagggcaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaactttcattaaatgacttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctcggatgaaaattaagggaattatgccacaaggggcgtttgcaaaaatttatcagcaaaaaacaaaaaatgagatcattacacttaaatctttagttacgccttatttggatcaaatatcggaacaaattcctgttgacttgagcgttgaaacagaatatggaaaagtatgcttaacggggagcattgacagtttatatcatcaaaaaatgcgaagagtaacgtggagagcctctgttgtcaaaacgaaagatattatccaaacatggatttattatttattacaaaccttggttggagagcctaattcgcaagttgagcattacgctttagacagcagactttcttttgaaaaaatagaaaaatctaccgcacttcaacagcttcaaacttatgttgaggcatatttacttggacaagtttcagtgttattaatgccaatgaaaaatttcgatcaatatcttcaattgctttttactccgaagagtaataaatggaaagaggaaaaggatattgatttatctgcttgttttgaattgttatcagaacttggctcaggtagaaaagagagaaatttttatgtgaaaacagatccttattggcaaagaatattagcacaaacaaaactagacgattcacatattttagaaattaatcaacgtgttatacaatggttcgatttaatgttaatgctaaaaagagttgaatagaaaataaaaacaaaactggatatttatccagttttgttttatccttagtgctttattttacgctatgtaaggtgagatatgattgggcgtgtaacaggaatactggttgaaaaacaagctccggaaattttactggatgttcaaggtgttgggtatgagttacttttacccatgacaagtttttataatttgccggaagttgggcaggaaactacgttgtttacgcattttgtggtgcgtgaagatgctcatttgttatttggatttagccataaacaagaccgctctttatttcgtgaattgattaaaaccaatggagttggaccaaaattagctttagctatcctgtctgcgatgtcagtgaatgaatttgtgtatgcgattgaacaagaagaattatctaaattagtcaaaattcccggagtaggaaaaaaaactgctgaacgtttattggtggagctaaaaggtaaatttaaaggcttacaacaaacagatttctttattaaaagctctcatttacctggaattaaatgctcaaaactggatcaaagtttgcagttggatgaagcagtttctgctttaattgcgttaggatataagcctattgaagcagagaaaatggttaaaaaagtgttaaaagcagatttaactagtgaacagcttattcgagaggctttgaaagccgcattataagagatagagaatgattgaagtagatcgcattgtaagtgccaatgcaaaagtagacgatgaatatattgatcgtgcaattcgccctaaattattgagtgattatatcggtcaacctcaagttagagagcaaatggaaattttcatccaagcagcaaaattacgccaagatgcacttgatcatttgttaatttttggaccccctggactaggaaaaacaacgttggcgaatattgttgccaatgaaatgggagtgaatattcgtactacttcaggtccggttttagaaaaagcgggggatttggcggcaatgctaacgaatcttgagcctcatgatgtattattcattgatgaaattcatcgcttatcaccagctattgaggaagttctttatccagcgatggaagattatcaactggatattatgattggagaaggtcctgctgcccgttcaataaagctggatttaccgccttttacgctgattggagcaacaacaagagcaggctctttgacttctccattacgagatcgattcggtattgtgcagcgactggagttttattctgtagaggatttagcttccattgttactcgaagtgcggtctgtttgcagcttgaaattgatgttgaagcaggacaagaaattgcttgtcgttcacgaggtaccccacgtattgcaaatcgcctattacgccgagtgcgagattatgccgatgtcaaaaatggtgggaaaattaccgcacttattgcacaagaagcactgaagatgctggatgtggatcttgcaggatttgattttatggatcgtaaattattacaggcaattattgagcggtttgatggtggacctgtaggattggataatttggcggcggcaattggcgaagagcgagataccattgaagatgtattggagccttatttaattcagcaaggatttttacaacggacacctcgtggaagaatagcaacatcaagaacttatcgacattttggtttggaacagattgaaaaatagcactcctttttcagttactctcaacgtgagtcagtcgatagtcaacgatttcaagcaacttgtgggtttgtgcgagtatccttctattctgtagtaaagattctgcaaaggtactatttattgctcaaaattccatttgcacacacataggctgagctccatgcccattggaagttataaccgccaagccgaccggtaacatcaagtacttcaccaataaaataaagacctttgattttatgactttccatcgtttttgatgagatttcttgcgtatctacgcctccaatagtgacttctgcggtgcgatagccttcggtgccgttaggttgaatttgccaatgatgaattaaatcatcaagattttttaactgcactttactgaggttggcaatcacttcatcttgaataatgttgtgatttaaccataaatccactagtttttgcggtaataggcgtgataaggcggtttttaaatgtaatttaggtgaggtctgacgtaacttgttaaggaaaaattgaatattttccatcggtaacagatcaatttctatattttcattcacttgccaataatttgaaatttgtaaaatagcgggacctgatatcccccgatgagtgaagagtaaattattgctgaaagattgaccgcactttgcggttacacaaacaggaagggagatgcctgaaagtgcggtgtaaaatttatcaatttcacgccatgtgaagggtacaagcccagctcgtggagcaataacattgagtccgaattgttcggcaacttggtaaccgaaaggtgtcgaactcaaggctggcatagacaatccgccggtagcaataactaaattttcacattgccaaatttttccgtcagattgcaattgaaaacgagctttttcattaccgtctaatttttcaatgtattcgatctgttgacgtaattgggtattaacttgaaatttatcgcattctgctcgtagcatattgacaatatcttcagcactgttatgacaaaaaagttgccccgattctttttcataatagctaataccatagtcagtaatgagggcaataaaatcccattgggtaaagcgagctagagcagacttgacgaaatgaggattttgcgaaaggtaatgctgaggggtaacattaaggttggtaaaattacaaaatccgccaccggacattaaaattttacgtcccactttttttccattatctaaaatcgttacttggtgcttggctttacctagttgaccggcacaaaacaagcctgccgcacctgcaccgataataattgtttgggaataattcatcattatttatttgctaaaattaccgctcttttgggagccgggtacccttcaatggttttactgtgatcttgaggattaaggaaatcaattaaactttcattttccagccagtctgttttacgttgttcttctagacctgttgtttctacatcgacacaacgaatattatggaaaccgcacttttccagccagtttatgagtgcgagaacggaagggataaaatacacatttttcattttggcatagcgatctgtcggcactaaaatcgtgtttatatcaccctctacaactaacgtttcaagtactaattcgccatctttaactaattgatttttaagttgtgtgagatgatccaatggagattttcgatgatataaaacgcccatagaaaagacggtatcaaaggcggctaaaggttgcatttcttcaatgccgagcggaatcagattagcacgacgatcattgtttaacagtttacgtacagcctcaaattgacataaaaacagttctgtcgggtcaataccgactaccattttggctccttcgccaaccatacgccacatatgataaccgctaccacaccctacatctaacacaagacgattctgcaaaggtgccaaatgaggcaagacacgctcccatttaaaatccgaacgccattcacaatcaatatggataccatatagatgataaggtcccttacgccaaggcataagctgttttaagtgatgaatgatgcgttgtcgctcaccggaggaaagaggcgtttttgtttcagctttgaccgcacttttgagatcaatatgatcggctgttaagtgcggtagaaaatcaatgatttttgaccatttaatataatcgccatgggtttgcttttcccattgtttaagttgtaaaggcaaagtttcaagccatgctgaaagtgtcgaagttgctatttgttgataaaatggacgaaagtcgaacataattattttgatgccttatatgcgtttttagcttgttcaaacgtctctaaaatcgatttttccggtttcactgataacaaagaaacaacaataatgacaatacttgccaaagcaaaacctgggatcatttcatataatttagagaattcacttgttgtagggacaatggttttccaactaaatacgataattgtcccagttaacattcccgccattgcagcagaagatgtcatgcgtttccagaataaagaaaatagtacaacaggcccaaaagcactaccaaatccagcccaagcaaattcaactaattttaaaacttggcttttttcatcttgtgcaatccaaattgcaatggtggcaatagctaataccattaaacgaccaagccacatcaattctttatccgatgcttttggacgaataaatcctttgtaaaaatcttctgtaacggcactggaagaaatgagaagttgtgcactcagcgtactcattactgcggctaaaatagcagaaagtaagataccagcgatccaaggattgaacaataattttgataattcaataaagatttgctccgattctttgttgacgacaccagctagttgtggatttgctgtaaaataggcgatgccaaaaaaaccgatacctatggcaccgactaaacaaaggatcatccaagtgatactaatacgtcgtgcgttattgagcgattttactgtgtgtgccgccataaagcgtgccagaatgtgcggttgtccgaaataacccaatccccaagaagccaagctcagtagaccaattgtggtagtaccggtaaaaatatctgtaaggttttttcctgctgcactttcagcttgcttcaagtagaaatgaaaattatctattccgtctaagtttagaataatcatgataggggttagaatgagtgcgaaaatcatcaatgttgcttgaatagtatctgtccaactcaccgctaagaaaccgccaatgaaggtataagcaatggttgccaatgcaccataccaaagtgcggtggaataagggatattgaacagattttggaataattttgcaccggcaacgataccggaagcacaataaattgtgaagaaaacaaggataattgaggctgacacaaatttgagtaaattataacgactaccaaaacggttgtgaaaatattcaggtaatgtgagagcgttattattaaattcagtgtaaatacgtaagcgaccagccacaaataaccagttaaaataagcaccgattgttaaacctatggcaatccaaccttcaattaagcccgacaaatagattgtacccggtaaacccatcagcaaccaggcggacatatctgatgcaccggcagacattgcggtaacaaaactgcctaaacgacgaccgccaagaatgtagtctgagagattattggtgtagtaatatgcaagtgcaccaatcaataacatgcctaagatatagacaataaaggtaataattgttggatcaaaactaaacattaagccctcacgaaagcattatttgtatagataaaatttaagaaaggtcgcattttaccttattcagggctattattctatttaccttttcgatagactaattaaaagaagtatttttaggatagagatgatggaatctgttgaattattggctaacattacccctagtgaaacccgaattgcactggtggataatggcattttaaaagaagtacatattgaaagacaggcaaaaagagggagcgtcggtaatatttataaaggacgagtgactcgagtattgccgggtatgcaatctgcatttgtagatatcggattggaaaaagccgcttttttacatgcctcagatattgtttcacatacagagtgtgttgatgttgatgagcaaaaacagtttgtagtgaaagatattgcacaattggtacatgaaggacaggatattgttgttcaggttgtcaaagatcccctcggtactaaaggtgcaagattaacaactgacataacactcccttctcgttatcttgtttttatgccggaaaatagccatgttggcgtttctcaacgcattgaaagcgaagaagagcgggcacgtttaaaggaacttgttttaccgttgtgcgatgaattgggcggttttatcattcgtactgctgcggaaggagcaacggaaactgaactcgtacaagatgcggagtttttaaaacgcttatggcgtaaggtgttggaacgccgtgcgaaatatacaacacgttcaatgttatatggcgaattggcgttaacgcaacgtattttgcgagattttatcggggcgaatttcagtaaaattcatattgattccaaattatgtttttctgaagtgaaacagtttactgaggaatttatgcctgaactgacagataagttggtgttatattccggcagtcagccattatttgatgtttatagcgttgaaaatgctattcaaacagctttaaatagtcgtgtaaacttaaaatccggtggctatctaattattgaacaaaccgaatctatgacaacgatagacattaatactggtgcttttgttggtcatcgtaatttagaagaaactatttttaatacgaatattgaggcaacaaaagctattgcacaacagttacaactacgcaatctgggcggtattattattattgattttattgatatgcaaacggaagaacatagggatcgtgtcttggaatctttacgtttggcattatccaaagatagagtgaaaacgaatgttaatgggtttactcaacttggtttagttgaaatgacacgtaagcgaacaagggaaagtttggagcatattttatgcgatgaatgtccaacttgcagtggacgaggcagtgtgaaaaccgttgaaacggtttgttatgaaatcatgcgtgaaattattcgtgttaatcatttatttgccagcgaaaaatttgtagtttatgcctcaagagcggtggcggattatttaattaatgaggaaagccatggtttattagcagagttggaagtcttcattggcaaacaaattcaaataaaaacagaagtgtattattcacaggaacaatttgatgttgttgtaatgtaacttccatttttaatatgttatattgacctcatattcattattcaaggtatcggtatggttaagaatattggaattttatatattgcgacagggcgttatcacgttctttgggaagatttctataaaagtgcggaaaagcattttctacctgagttacctaagaaatattttttattttctgattatgagggaagttttttaggagaggaaagtggaaatgttcacagaatatatcaaaaaaaattaggttggccttatgatacgttgatgcgttttgatatgtttttaaaagagaaagagcgatttaaagagttggattatctcttttttgttaatgcgaatatgatttttattaaagatatacatcaaaatgaagttcttgcatccgataaagagttaattatgattttacaaccttggtttatcggtttagatattgataaaactacttatgacagaaatccgttgtccacgtcatatattccttatggggagggtgaacattatgttatgggcagttttaacggcggtaaaacgtctgcttttttagagatgtgtcagcaattaaatgacaatatctatttagatttaaaaaaggacattattgcactatggcatgatgaaagtcatttaaatcattattgttggcgaaataaagaaaaaatatttattttgccggatagttatttgttggatgaagggcaacagtacttcccaagtaaaaagtctcattatattaatcccttatatttaaaaaatcatgatgttcggttagttatgagaaataagaatcattataggttcggggggggggaattacatgagagggattactgatgaacggatcgaatttaattggtcaatttttttgttgaatttaaatgtgtatcgtctctatttaaaagagagaattagggctgtatttaaagttctttgtaagaactaatattgttaaggtaggacaaaaaaacaagatgttaaacaaagtacaagaatctatacttgctccaaataatttagaactggataatttaaaaaatacatttgatatgttgtctcatcgccagattgattatgcagatttgtattttcagctcagtcaagatgaaaattgggtattggaagacagtattatcaaagaaggcggttttcatattgaccgtggcgttggtgtgcgtgcggtaactggcgagaaaacaggatttgcttattccgatcagattgatttggtcagtttacagcaatgtgccaatgcagtaaaaggaattgctttgccaaatcaaggtaatattattaaaccgattggctttaacgctgtaaatgcgattactcgttatcctgcagtaaatccgttaaatagtttgaataaagagcaaaaaattgaattattacatttagtagaccgtaccgctcgtgcatatagcccttatgtgacaaaagttgtagcgaatttaaccgctctttatgaagaaattttagttgtggcaacagatggtacgttagcagctgatgttcgaccgttaattcgtttatctattttcgtgatggcggaaaaagcgggaaaaagagaacaaggaagtgcgggcgttggggcgagagtaggacttgattggttctttgagccttataagggcgaacaacgtgcgatttattttgcgaaagaagcagcacgtcaagcattggtgaatttagacgctattgaagcacctgccggcttgatgccggtagtgttgggcgccggttggccgggtgtattattacacgaagctgtggggcatggattagagggtgattttaaccgtaaaggaagctcattgtttacaggaaaaattggggaattagttacttctccattatgcactattgttgatgacggtactctaccgaatcgcagaggctcgttgacaatagatgatgagggcgtgccaagtcaatgtaatgtattgattaaagacggtgtcttgcagggttatatgcaagataaaatgaacgctcgcttaatgggtgtgaaaccgactggaaatgggcgtcgtgaatcttatgctcatttgcctatgccaagaatgactaatacttatatgttagcggggcaaagtaagtttgaagatttaattgcttcggtcgattatggcatttttgcaccgcactttggtggtgggcaagtggatatcgtctccggaaaatttactttttccatgtcggaagcctatttaattgaaaaaggcagaataaccaagcctattaaaggtgcaactatgatcggacaaggaattgaagtgatgcaacaagtatctatggtagccgataatatggaaatagaccatggcataggtgtttgtggtaaagatggacaaagtgttccggttggcgttggtcaaccggcttgtaagatagagcaaattaccgtgggcggaaccgcttaattaaactatggtgaatttgtgatttgttagataattaatttttatagagaatatagacagtgactgaaacgactcaatcaaatttgcaattggctcaagcatataacgaactaccttatacttctaaagtttttgctgcttgtcaacctactcgtttacatgctttagctaagattaaagggcttttaccccccccccttagaaacagctaaggtgctggaaatcggttgttcttttggcggcaatttattgccctttgctattcgacaccctaatagccagttagtcggtattgatttatctgaataccaaattaatatcggccagcaaatgatggaacaggtcggcgtgaaaaacgtagagttggttgctgctgacattagccaagtgagctttaatattaagtttgactatattatttgtcatggtgtttttagctgggtgccggaagcggtacgccatgcaattttaaaaaccatccaagagtatttatctcccaacggtatcgctcatattagctataatacctacccaggctggaaaattcgagatgtcgctaaagagctgatgtgttttggaagcaatccgaatttaagcagtttggagcgtatagaccaatcttttgagttattaaaatttacctcttccattttgcaacgaaagaatgctgacttatataaagtattatcgcattcatttcaagaaatacctgataaagataaattttacgtggctcatgaatactttgaggattttaaccaacctttctatttcagggaatttatcagccaacttgaggcataccatttagcctatttaaccgatagttcttttcccgctatttattcagatgtgcattttgaacatgatgaatatgagaaagtgtgtgcctattttgattaccgcttggaagccgtagaacaatttattgatttcctgaataaccgctcttttagacacagcattattacccatcaacaaaatttggcggacaaagggattaccaataatatcagtcaatacaatcattgccatcatttctatgatatctatttcagaacagatgtgcgttatagccctgcgactgatgataaggaagcgcattggcagttgttggacataggtgcggaaatttcggataccccattaaataatttattatgtacttatcttcaagagcataacaatccttgtaaaattggcgatatttgtgagtatgccaaaaaattccccgaatatgacgaaactgaactttacaaattaattctttctattatttattctaatcatgtttatttatgttttgagccagaaacatcgaccggctatgacagcaaacccaaattgtttgagccgtaccgaagattgattgatttggtcagacataatcccaatattacctgcttgtccaatcgatactatcaggtactcaacttagatttcttgccgcaatatatcgcacaatttctcgatggcactagaacagtcaaggatttaatcaaacaattgcgagaggacattgaaaacaataccattgtccttcatgatgaaaacggcaatgaactttcgaataaaaagattaaagataaagacatcaaagaagtgattgttcggcaattggacgcacttaaggagtacggttatttcacggaatataaatagtactgtgtaaattgtccaatcgtgagatagtataatgagcgtatttaatattgcattgaatacgctctatttgtttaaatttaaactttaaaatcaggtgctaaacaaggttggattttattgagtatttcttttacaagacgtggtgttgctgcaacgatatgactgtcagtgaaatatttatgaccaccgtagaaatcacatactaaaccaccagcttcacgtaaaatcagatcacctgccgtaatatcccaaggtttaacgcccatttcaaaataaccgtcaacacgattagccgcaacatagcaaagatcaagtgcggcagaacctgcacgacgaaaatcagcaacattttcagtaaggttactcatcatagcaaattgggttggcatgagagagggttttttgaatggaaatccggttgccaaaattgcaccttgaaggtcacgtttactgctatcaacacgtaaacgtaattcattaattttcgcaccttcaccacgcacagcggtgaataattcattgcgaataggatcataaaccacgcctatttcagtgcgaccttttacacggacagcgatagatacagcaaagtgcggtaagcctttgacaaagtttgtcgtaccatctagtggatctattacccattgaatatcgttgttttgtccttcgtgagcaccgctttcctcagtaataattgtatgctcgggataagatttgcgaacaacctcgataattgctgcttctgaggctttatcaatattcgtaacaaaatcatttatacccttttgcattgtttgaatttcatcgcggcgttcataacctttaacaattatattacccgcttttcgtgccgcacgaatagcgatatttaacattggattcatctctttccaccagatttcaaagaacacatggggtgggattatagtgaattttgcctataaaagcgagtagattttaggtttcctaacggttttttagggatcaaataacttttcgtaaattataggggctatgctaaaatacccacaattttaagtaaggtaaaagtcttaatgttggaaaatatcaaaattgttttagttgaaacttctcacagtggcaacattggttctgctgctcgtgcaatgaaaacaatgggactaaatcaattatgtttagttgcacccaaacagggaattgatgaacaggctgttgcgttagctgcgggtgctgaagatgtggtaaaaagtgcggtagtggcggacagtttttctcaagctgtagcggactgttctcttattattggcacaagtgcgaggttaagacatttacaaagtaccttaattgaaccgagagaatgtgctgaaaaagtcatacaaagtttgtcatctcaaaaagtagccattgtttttgggcgtgaacgagttggactgacaaatgatgaattattaaaatgccattatcatttaactattccggctaatcctgaatattcttcattaaatctggctatggcagtgcaattaatcagctatgaacttagactagcttggcttgcctcgttaaaagaactgaaacaaccgttttctgtgatagcaaataactatccgacatttcaagaattagagcatttttttgcacataccgaacaactctatcaacaacttggttttattcaaaatcaaggggttatgaaaaaattaagacgtttatatcagcgtgttcaacttgaaaaaaatgagttgaatattttgcgtggtatgttaagtgcggtagaaaagcgaattaattgcaaaaaattagaagttgactaatttagtaggattagtaatatatccgctcaatgtggatctaaaggatattgagaatgaaattaacatcaaaagggcggtatgcggtaacagctattttggatattgcgttaaatgctgagcttggacctgttagtttagcggatatctctgaacgacagcatatttccctttcttatttagaacagctttttgctaaattacgccgtggtggtttagtgaaaagtgtgcgtggtcctggtggcgggtatcagttaggattatctactgatcagatctccattggcatggtaattaacgcagttaatgaaaatattaacgttacaaaatgtttggggaatggcgattgtcaggggggagtaaaatgcttaactcattctttgtgggaagaattgagtgtacgaattgaaaatttcttaaatgaaataacgattgcagaattagttgcaaaacaagccaagtgaaatgagcagtacacgtttgagatagtgataaaaccggctaaaagtgcggtacaagaaaagattttttaggagagagtaatgaaattacctatttatttagattatgcggcaacttgccctgtggatgaacgtgtagtgaagaaaatgatggagtttttaagcattgatggaaattttggaaacccggcatctcgctcacataaatttggttggcaggctgaagaagcggttgatgttgctcgcaatcatattgctgatttaatcggtgcggacagtcgtgagattgtttttacttctggtgcaacagaagcggacaaccttgcattgaaaggagtgatgcgtttctatcaaactaaagggaaacatcttattacctgtaaaactgaacataaagcgatcttagacacttgtcgccagcttgaacgtgaagggtttgaagtgacttatttagatcccaaatcagatggtttgatagatttagaggaattaaaatccgttattcgtgatgacacggttttggtttctataatgcacgccaataatgagattggtgtagtacaggatattgctaaaattggtgaaatttgccgtgaacgtaaggtattatttcacaccgatgcaactcaatccgtcggtaaattgcccattaatttgagtgaattaaaagtagatttactttctatgtccagtcataaattatatggacctaaaggtataggtgctttatatgtttgccgtaaaccacgagttcgtttggaggcaattattcatggcggcggtcatgagcgtggtatgcgttcaggaaccttacctgtacatcagattgtgggcatgggtgaagcatatcgtattgctaaagaagaaatggcaacagaaatgccacgcttaaccgctttgcgtgatcgtttatataacggcttaaaagatattgaagaaacctatgtaaacggttcaatggaacaacgtttaggtaataatttaaatattagttttaattacgttgaaggtgaaagtttaatgatggcgttacgagatattgcggtatcttccggttctgcctgtacatcggcaagtctcgagccttcttatgttttgcgtgccttagggttaaatgacgaattggcacatagctcaattcgttttactgtggggcgttatactacggaagaagaaattgattattctatcggtttagttaaaagtgcggtgaaaaagttacgtgatttatctccactttgggatatgttcaaagagggtattgatttaaacagtattgaatggactcatcattaatagaagagtttagcagtttgttgggtaggtttatcgcttacccattttaagaaatgagaaaaaataggaacgaaaaatggcatatagcgaaaaattacttgatcattatgaaaatcctcgtaatgtaggttcgtttgataaaaaagatccgacagtcggtagcggtatggttggtgcacctgcttgtggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattataaagcgaaaaaagctgaatagctaaagaagattaaaggagtaatgaggtgcatataattttaatattaagccacattattccttttgtgtttagttccctttagttggatttatgtttagataggtagttaaatttctagcagttataatgagttgagaattaactatattgattaaggagaataaatgagtatcaccttaacacaagcagctgcaaaccgagttcgtacttttttagaaaaaagaggaaaaggaataggtttacgtttagggattaaaacgtcaggttgctcaggcttagcttatgttttagagttcgttgatgttttaaatgaagatgatgaggttttcgagcaagatggcgttaaggtgattgtggatcataagagcttagtctatttagacgggactcaactggattttgtcaaagagggactaaatgaaggctttaaatttagtaatccgaatgtaaaagatgaatgtggttgtggtgaaagtttcaacgtataggcaggcatatatatgataaatccatttgcgttatttgatttggaaattgattttaatcttgatcaacaaatactctcacagcgttatttaacgctacaaaaatctttgcatcctgataattttgctcatagatctgcccaagaacaacgtttagcactgcaaaaatctgctgaaattaatgatgctttacaaatactgaaagatcctatcagtcgtgctgatagtataatcaatttgcatcttggtgaacaaaatatagagcaaaaaactaatcaagatatgatgtttttgatgcagcaaatggcatggcgagaacggttggagcaagttgagcaacaacaaaatatggataagttattacacttctcgcaagaggtcgagtgtgtacaacgtgatattttagcggagctacaagaatttctggcacaacaaaattggcaacaagctcaattgctaaatgatcgtttacgttttattaaaaaattatttgttgaaattgaacgggttgaagaacagttagctggtttttagctcagtaatttatttagaaagttatgacgagataatagagtatggcattacttcaaattgcggagccagggcaaagtgcggcaccgcaccaacataaattagctgtaggtattgatttggggacaacaaactctttggttgcagctgtgcgtagtggaagtagtgaagttttgcgggacgaacaggatcgcttgcttattccatcgatagttcatttaacagaagatcaagcgattgtggggtatgaggcaggtcaacttgccagtcaagatccgcaaaataccattatttccgtgaagcgtttaattggacgtagttgtactgatgtacagcaacgttatcctaatttgccttatcaatttaatgcaactgaaaatggcttacctctattaaagacaagacggggattattaagtccggtagaaatttcagccgaaattttgaaaaaattgaccgcacttgctgagcaacgtttgggtggagaattaactggtgcagtgattactgttcctgcttattttgatgatgctcaacgacaaagtaccaaagatgctgcaaagttagcaggtttaaaggtattgcgtttacttaatgagccaaccgcagctgccatcgcttatggtttggatagtggacaagaaggtgtgattgctgtttatgatttaggcggcggtacttttgatgtgtccattttacgcttatccaaaggtgtgtttgaagtgcttgctaccggaggtgataccgcacttggtggtgatgattttgatcatttattagcggagtggattgtaaaaaaatcaacagtcgcacctcaaaatgatcgtgaaaaacgtcaacttattgaagtcgcaaaccaagtcaaagttgctttgaccacgaacgataaaatccggatttcttatgcagagcaaaatctggaaattatgcgtgatgaatttaattttctgatttcaggtttagtcaaacgttcattattagcttgtcgtcggacgttaaaggatgccaatttaactccatcagatatattggaagtagtgatggtgggcggttcaacgcgtattccttatgttagagaacaagttggtgagtttttccaatgtacaccgctgacttctattgaccctgataaagtggtggcattaggtgcagctattcaggcggatattttagtaggaaataagcctgatagtgaaatgttattgctcgatgtgattccgttgtcattaggtattgaaactatgggaggcttggttgagaagattattcctcgtaatactactattccggtagcaagagcacaggaatttactacattcaaagatgggcaaacagctatgtcggtgcatgtgttacaaggtgaacgtgaaatggttactgattgtcgctctttggctcgttttactttacgaggtattccggctatggtggcaggtgcagcacgtattcgagtcacttatcaagttgatgctgatgggttattaagtgttactgcggtggaaaaatcaacaggagtacaagcatcaactcaagtaaaaccttcctatggtttaactgatgatgaaattgctaatatgctaaaatcctcaatggagcatgctaaagaagatattcaaactcgtttactaacagaacagcgtgttgatgctaccagagtcattgaaagtgtttattcggcattacagcaagatgaagatcttttagatgataatgaattaagtgcggttaaaaatgccttagtttcattacaaaaattgattcaagaagaagatagccttgctattaagcaagggataaaaatgcttgatcaagcaacgcaagaatttgcctctcgccgtatggataaatctattcgtcgagcattaagcgggcaacatattgaacatattaaataaaggaaagtagaatgcccaaaattgtttttttacctcatcaagatttttgtcccgaaggaatggttgttgatgctgcaccgggagaaaatctattagacgttgcacataatgcaggcgtggaaattcatcatgcctgtgatggctcttgtgcttgtaccacttgccatgttgttattcgagagggatttgacagtttaaatgagacaacagaacaagaagaagatatgttagataaggcttggggcttagaaatggatagccgtctttcttgtcaatgtgtggtcggagaggaagatcttgtagtagaaattccacgttataatttgaatcatgctaatgaagcggctcattgatccatttatatcaaggtgcatttagcaccttaattattatgctcaaattatataagttatatccaattattctctgctttttgagcgaaaattcagtaatatacaggctttattctcaagtaaaggggatataaatgaaaatccaacatttaattaagcaacatcaacttggcttattgtttcaacaaggctcctttggtttagaaaaagaaagccaacgagtttatcaagacggttcggtagtaacaaccgaacaccctaaatgttttggtaacagatcttaccatccctacattcaaactgattttgcggaaagtcagctcgaattgatcacgcctcccaataaaaatttagaagatagtttaagatggttatccgctattcatgaagttgttttgcgttctttgcctgaggatgaatttatttttccgttgagtatgccggcaggattgccttcagatgaattgataaaagtcgctcaattggataaccctgaagatgtggcatatcgtgaacatttagttcagtcttatggaaaaaataaacaaatggtcagtggaatccattataactttcagttggctccggaactcattcaaaccttatttgatttacagcaagagcaaaaaagtgcggtagattttcagaataatttatacttgaaaatggcgaaaaattttcttcgttatcaatgggttttattgtacttattatcagcaacaccaacggtagagagtaattattttaaaggtagttcgccattaggaaaaggtgaatatgttcgcagtttacgttcaagcaaatatggttatgtgaatgatcctgaggtcattgtttcttttgatagtttagaacaatatgcagaaagtctggagcattgggttaaaagcggaaaactgatagcagagaaagaattttattccaatgtgcgtttacgaggtgcgaaaaaggcgagagatttaattcaaaatggaattaaatatttagaatttcgcttgtttgatctcaatcctttcgagcaatacggtatgagccttgcggatgcaagatttattcatcattttgtactattgatgatttggcttgatgaaatgccagatcaacaaggtgttgaactggggcgtagccgtctagcggaagtagctctagaaaatccgttggcacaaactgcctatcgagaagaaggtgagtggttacttaatcagttaatcagtatgttacaaagtatcggggcagaccaaagtgcggtgagttttgtccgagaaaaattagctcaatttgctgatcccgggttgacgttatgtggtcgtttagtccaagaaattgagcagaaaggcggttatcaaaaattaggtgcagagcttgccaaacaatataaagaaaatgcttttgagcgtttttatgcgttaaccgcttttgataacatggaactttcaactcaagccttaatgtttgatttaattcagcaaggtatcagttttgagatcttggatgaacgagatcaatttttacgcttacaatttggtgaacatgttgaatatgtaaaaaatggtaatatgacttcgaaagatagctatatttctcctcttattatggaaaataaagtggttacgaaaaaagtattggaaaaggcggggtttaatgttccacagagtcaggagtttacttcagttaaacaagcgatagtcggttatagcctgtttgaaaaaagagcggtcgttattaaacctaaatctactaactatggcttggggattacaatttttcagcaaggtgtgaataatagagaagattttgccaaggcagtggaaattgcgttccgtgaagataaagaaattatggtggaggattatttagttggtactgaataccgcttctttgtgttgggtgaggaaacattggcagttttattacgtgttccggcaaatgtagtaggcgatggcattcatactgtggctgaattggtagctcaaaaaaatgctcactcattgcgtggtgatggtagtcgtacgccattgaaaaaaattgcattaggcgatattgagcaattgcagttgaaagagcaaggtttgactgttgagagtattccagctaaagatcaaattgttcagttgcgggcaaattctaatattagtacaggcggtgacagcattgatataactgatgaaatgcatttgagttataaacaactggcggtggggattgcaaaagctatgggggctgctgtgtgcggtgtggatctgattatttccgatttgaaagaaccggcacagcctgatttaagttcttggggcgtaattgaagcgaattttaatccaatgatgatgatgcacatcttcccttatgccggacaatctagaagattaacaagaaatgtgattaacatgttgtttccggaagtaaagtaaataatgtttttcataaaataggcagtttttagactgttaatgataagggctggtagtttacccagaaatttgatttgctggtgtaatggaaaaaatggttgctaataatatatttttgacgttattagcaacgattttgtctattatgctactgcttgtggtaagcaattatagtgagtcctccaacaaaacagattctaacgcaatttcgatcatttcattgaaagttaattgtcgctcttctgcactggtttgttcatgcgtacggatatgatcagaaacagtacagattgttaaggctttggctttaaattcagctgctacaccataaatgccggcagcctccatttccacacctaaaatgccatatttttccatgacatcaaacatttccaggtctggtgtataaaataaatcggcggaaaacaagttacctacttttacatcaattcctttattttttgcagcctgtacggctgctcgtgccatgccaaaatccgcaatggcagcgaaatcgttatctttgaagcgaatacgatttacttttgagtcggtacaagcaccaagaccaataatgacatcacgaattttgacatccatgttgactgcaccacaagaaccgacacgaataattttttttacgccatattctgtgatcaattctttggcataaatggagcaagacggaatacccattccatgtcccatcactgatatttttcgtcctttgtaagtacctgtgtaaccaagcatattacggacatttgttacttcttgtgcattttctaaaaatgtttctgcgatatattttgcacgcaacggatctcccggcattaaaacaacatcggcaaatgcaccggctggtgcgttaatatgtggcgtcataaatgtgtccttttgttgattaaaatattatttttccttaaagcaataaagcaatcgttttcttttacctaaaatgaacacaccacgaaaggtcatggtgtgaaatatggatgacggaattaaaccgcacttttacagtgcagcaccgcttaatccaataaatagacctgcaattgttgcactcattaagtttgctaatgaaccggcaattaccgctttaatacctaagcgagcaatatcaccacgacgatttggtgccattgcccctaagccaccgattaaaattgcaatagagctaaagtttgcaaatccacagagggcaaaagtaataattgctttagttttatcacttagttgcaccgctgcatcagctgcaaggtatggtacaaaatctaaataaccaacaaattcattaattgctaatttggttccaatcatacgaccagcaatttccgcttcttcccaaggaaccccaataatgaaggctaacggcttgaaaacccaaccaaagatcatgccaagagaaagtccttcttgaccaatccagtttccgatagtgccaagaattccgttaagtaatgcaattaaagccacaaatgcgatcaacatcgcacccacatttaaggcaagttgcataccagatgatgcacctccggcggctgcatcaagaatatttgttggtttttcttgttgtatttgttcgaaattatcattaaatttttcagtttgtgggataagaattttagcaaataacaatccggctggagcagccataaatgaagctgcgattagataggttagaggcacacccattccggcatatccagccatgactgaaccagcgatagaggctaaaccaccgcacattactgcaaacagctctgattctgtcattttgctaatataaggtttaatgactaagggggcttctgtttgtcccacgaagatattggctgctgccgacatagactcggattttgatgtgcctaatgctttttgtaatgctccgccgatgattttaatcagccattgcattacaccgatatagtaaagtagggagattaatgcggagaagaaaacaatatttggaaggacgttgataacgaaaacaaaaccggctgagcccatagaaccatcggcttgtggcgctaacccattaaatagaaaacggatcccttcattaccataattgatgactgattgtactgctcctgcaacgctttgtagtgcctgacgaccaacgggaacataaagaataaatgcaccaaataaaaattgaattaatagtgcacctagcactgtacgataattaatcgccttacgattattagataaaagaaaggctattaataataaagcgaagataccgataatgctaatcagagaactcataatgtgaatatccttataggtgtgttaaaaatgcacgtattctactcggttttatataaaaaatcttgtactttctaagtgagttatggcttttttaaatttataaatattctttgttttggattaaatttaatttcgattatgattaacacaacgcaactgttgggtcgtaataatgaaaaaatttaatgagcttcctcaaactccttgggctgccaaatctttgtgggaaatagaaacaaagtcgctattggtattatgtttttcactttccttgctcggtattggtgatggattgttggttttatccaatttaggctctgcaccttggacagttttgtctcaaggcattgctttacaagcacaatttagtgttggctgggcatcatttatagtaagtatcttagtaatgttaatgtggattccgttaagattaaaagttggttttggaacaattctgaatgttgttctgatcgcattatttcttggtttaagtatattttatatttctccgccgagttcccttttagcaaggttttgctatcttataacgggtattattttttttggtatcggaaccgcattttatttgacttgccatcaaggggcaggacctcgagatggattaatggttgggttatgtcatcgctttaaattaagaataggaatagtccgtactcttatggaggtttctgtttgttttttgggttttttgctaggcggaacagtaggaattggtacactattatttgctaccagtattggttggattattcaattaggggtttattttattatgaaacttaacaagtcggtctaagaaatatggcattattgccagtcttaattttaaagcatataatctttgccattttattctatatctaaataaacctatgatgagattaccaatcagtgtcacaatgcttgtgaaaaatgccgagaaatatttggcaaaaagccttagttctttgaaagatttccctgaaattattgtgttagataatggatcaacagatcgatctattgaaattgcaaaacaatttactaatgtcaaaatttatcattcacctttcattggttttggaccgatgaaaaatttagttgcaacttatgcaagttatgattggattctaaatattgatagcgacgaaattttacaaccccagcttattcaagagatttctcagcttaatttcgatgaaccccgcaaagtttacgcattgttaagaattaatcattaccgtggaaagccaataaaaacttgtggttggtatcccgactttgtgaaacgtttatataataaaaagttggtaaaatttgatgacaagcgagtgcatgaggcattagagattgcagatgatatacaggtagttcgcttaaagcatgaatttaatcattattcttttgatagtagtgagatgttgattaataaaatgcaacattacaccgctctttttgcggaacaacaaaaatatagaaagaaaagtagtgtattgtcagcaattgctcatggaatagttgcatttttcaaaagttatatattaaagagggggattttatcgggaggcgatggttttattatttcttttgccaacgccagcggttcttactataaatatattaaattaatggaagctaatcagagtttaacaactgctttaattataacaacttataatcgcccagatgccttagaggctgtgttagtatccgtattagcacagagccttttgccgaatgaagtaattatcgctgatgacggctcaacagaagataccaaagaacttattcaaaaatatcaagcaatttttcctattccacttaaacatgtttggcaaccggatacgggctttcgtttagctgaatctagaaacaaagcattatctttagttgagtcagaatatgtaataaccattgatggcgatatggttttacatcctcaatttatttcggatcaccgtaaagcggcagaaaagaatgtatttgtgggggggggaagaatattgctcactaaggataaaacgaccgcacttttacaatcatcagaacaatattcctcttttaaatggtatgaaaaagggcttgaaactcgttttgaaaaacgtttaatggcgttgcatattcctttcttgtctgaatttatccaaagaactaaaagagtgcattattataacgggataagagggtgtaatatggcattctttttatctgatgctttagaaattaatggttttaataatgattttgttggttgggggcgtgaggatagtgaatttgtcgctcgtttttttaataatggaggaaaaagaaaaaacatcaagtttgcagcgattgcatatcacttgtggcatcctgaagaagatagaaaagccttgccggttaatgatgaattacttaaacgagcaattgaagataaattggttttttgttcaaatggattgaaccaaattaaattggattaaatattattctttatatttttgtaacgcacttttcagcagggagatgtaaatagacttgctttttagctaaaaaagagtacaatcttcaggctttttgtctatatatacagagaaaaaagtaagcattcccactcttttgatgtgggttttcttttagtttaaattagttagaggaaggttatggtaaccattcgtttatctcgtggcggttctaaaaaacgcccgttttatcaaatcgtagtagctgacagtcgttcacctcgtgatggtcgtttcattgaacgtgttggttttttcaatccgttagcatcaggtaatgttgaacgtgttcgaatcaatttagatcgtgtgaatcattggattggtcatggtgcatctttatctgatcgtgttgctagcttagttaaagaggctcaaaaggcagcttaattttagcgattttataggtgaatgaaatggaacaacaaagaatagaagtcgttggaaaattaggttcaacatacggaattcgtggttggttgcgtctttattcatcaacagaacaagctgaaagtatctttgattaccaaccttggtttttaaaaatcaaggggcaatggcaaccaattgaattggaaagctggaaatttcataatcacgagttaattgttaaattaaaaggcattaatgagcgtgaggtcgcacaaactctggcaaatgttgaaatcggagtaaatttatccatttttcctctattagatgagggggatttttattggcatgatttaatcggttgtcaagttgtgaatctacaaggttatgcaatgggtgttgtgtctgaaatgatggaaaccggtgccaatgatgtgttggttgtacgtgcaagtacaaaagatgcttttggtaaaaaagagcggttgattccgttcttatatgaacaagtagttaaaagagtggatctcagttctaaaactattgaagttgactgggatgctggtttctaacctcaggtaatctgtaacgctttggcagtaacataaacacagaaggtaagtaaatgtggatcgggattattagtctatttcctgaaatgttcaaagctattacggaatacggagtaacaggacgagcagttaggcaaaacctgctggagatacaatattggaatccgagagatttcacctttgataaacataaaacggtagatgatcgcccttatggtggaggaccgggaatgttaatgatggtgcaacctttgcgtgatgccattcattgtgcaaagtctgtggcaggtgatggtgtgaaagtgatttatctttcgcctcaaggacgtaaactggatcaaaatggtgttcaagagcttgccagaaatcaaaaaatgatttttgtttgcgggcgttatgaaggcattgatgaacgattgattgaaactgaaattgatgaagaatggtcaatcggagattatgttcttaccggtggggaattgccggcgatgacgttgattgatgcagtcgcaagatttgttccctgtgttttgggtaaacaagcctctgcacaagaagattcttttgcagaagggctattagattgcccacattacacaagaccggaacaattaaacggtttaactgtacctcctgtattgatgtctggtaatcatgaggaaattcgtaagtggagattaaagcagtctttgcaacgaacatggttaagacgacctgagctattggaaagcctagctctgactgacgaacaaagtaagctgttatcgcagattaaacaagaaaacagttaatcagttaaatctaggatataagaaggattactacaatgagtaatatcattaaacaaattgaacaagaacaattaaaacaaaacgtacctagcttccgtccaggggatactttagaagttaaagtatgggtagtggaaggaagtaaacgtcgtttacaagcattcgaaggtgtggttattgcaattcgtcaccgtgggttacatagtgctttcactttacgtaaaatatctaacggcgtaggtgttgagcgtgtattccaaacacattcaccaattatcgacagtattactgttaaacgtaaaggtgcggtacgtaaagccaaactttactatttacgtgagcgttcaggtaagtctgctcgtattaaagagcgtcttggtaattagtttattagacttatataaacaaccccttggatactccaaggggtttatttatagaaagattggcatgttttgaccttaaatcataaaatccaaccattaatagaacattaagtaatatgatgaatgagcacatattacaataatgcaaaatgcaaaaattccacaaaatgatctgcccagtgtttttcatggtgaatttcatttgccatcattcgtaagcgaatgttatctaatggatgacctgtgcgtaataaggcttggtaataatggagtgtgcaatcaatataggcttggttcatatttgaaataaataatgaatcaacatcatctccttctttagtgcctacttgaataaagactttactatttttatcaattggattgtggtggataaaatgcagaaaatctttttcactaaaccaagatgcgagagaaaaaacacctaaatgtccaaaaatttgtggatatgctgaccccatataggcagtgataattcctcccatggaactaccggcaagcaaagtatgttctttttgtggtttagtgcggtaatgttgatcaatgaatggtttaacgatctcgactacccatttgccgtattccatacctttcccaccgcactttttaatttccggtgacgagcctacgtcagtacgccaaggtccatattcatcaagacgatctacacctgaattatctatgccaacaataataattttaggaaattctttatggtgtttaatggttggaataattttccaagagtaacctgagtaagattctttactataaaaaatattttgtccgtcatgcatatagagtactgcataactatcccacgtatctgtgtaataatcttttggcaataacactcgaatacgacgagtgcggttatagtaggggacgtaaagaaaatgttcttccatttttaaataataattagtatttttcacagcaaaaaccttataaaagtaaaacaaagtgattttttaaatactttcacctaaatgaatattatatccgagattgatcatgtaattttcaggtacaataccttctatacgattaagtaattcttttgccgccacttcaccgatatttaagcgtggtgtgcgtactgtggcaatttgtgtcgttaaagataatccaacatttaacccatggaagcctgcaataccgatttctttaggtacgtcaattccttgacgttgacattcaaataacgcaccaattgctaaatcatcattggtacaaaaaatgccatcaatttggggatgtttttttaatgccagttttaattgttccgcacctaaagtaaatgatgagggttcttccgtgaggagactgtgaggtgtcagttgatgttttttcattgcttgttcgtaaccctgcatttttaaacgggtacgtttatccatacgagcagagaaatagacaatatttttatagcctcgtttaatcattgtttccaccatagactgtgctgccgctatattgttgaaccccaccacttgttgtaaaccgaattcgctggtatccataatttcgacaacgggaatatttgccacatctaacatttttagcgttcttgccgaatgttctgtttccgacaaaataagtccatcaatgttataagagagaagcgattcaattcgtttttcttctttttcttgacaataaccataatgggctaacatggtttgataacctgcttgatcggtaatattctcaatacctttaattacatcggcaaaaacatgatttgttaaagagggtacaagtacaccaattgctttgcttttcgcattggataaaatttccggtgcacgattaggaatatatccgaagtgttctatagcttcggcaatacgcacacctgtttttggtgcgacaagacgtggatcacgcaaataacgacttatcgtcattttagtaataccaagatgagaggcaatatcttgcaaagtggggcgtttacgtttatcgggcatttcttatcctaacataactttacttctgtccattttgccagcaatatgcctgttgcaacagaaacattcaagccgtgttttaatggattaactaatgacaaattaatcagttcatctgctttatccgctaatgattcagtatcagcttcactcagtacaaatgcaactttatcatcgagttgtaattgcttaatggttttggcgtgtttatttgagcttagatgaacgatttgatagcctgcttgtcgcaatttaaccaatgccgtttcagtgcgatcaatttccagcggatgaatatattccataccgccttctgccactcgcattgctactgcagaatgaagaagttcaacatcgtcaataacaaccgcacttataccataacatacacaagtgcggataattccgccaatattatgtggattacgcacaccatttaaaaccaataggcagtttttttgctgtggaatatctaaatagccgtgcaaagtaaatggacggcgttttttgaccaacatgcaaataccgccgtgatgttcagtgccgctgactaaggctaactcgctattatctactacatgatagacttttttattgctggctaaatagctaaacaaatcccccactttatgtgccatttctaccgtagtccaaacacgcacaatactttccggacgttgtgcaaaaagggataaacaagcattttcaccatatactttcatttcctctgcacgatttttcttgatcttctccggtgcacgtggcgataaagggccagttttcttttcagtttttgcaactaaacttgaacgttttagcacaacttgtacttgtcctgtaccgtttggcttttccatagtggtattgataatatgagtgtgggaagccgtattttgtgtattttgagggcgagagtgccgattggataaagctcgctttgagttattgtcaacgtgcggtgattttgatgtagatttttcatatcttttgttgctgacaaagcgttcagtaaagcgtttttcattatttgcttgttgaaaaattggtttttttgtcttcatgttggatattaatttaaggttagaaaaagataaagtgagcaaaaaaacaccgcactttatagagttttgtgaacattataacgaaaaaataccttttttctaccaagttaccgactaaatattgtaaactagccagccaaacacaaactcgtagagaagtgaattatgttgatcaataaaacaaaacgggcgaaacaaaatttggagcggttaccttgtattcctttgcaagcagagcaagttgagtttatttatcattcttcagattttaaacaacagattattcagtgtattcgtcaagcaaaatcaagaatttatttcaccgcactttactggcaaaacgacgaggcgggacagcaaatcctagatgagatttatcgtgctaaacaggcaaatcctgaattagaggtaaaaattttggttgattggcatcgtgcacaacgtaatttacttggtgctgagaaaagtgccacgaatgcggattggtattgtgatgaacgcagtaaatatcagttggctgacgatcctaatatattttttggtgtgccaatcaatactagagaagtattcggtgtattgcatattaaggggtttgtgtttgatgatacggttttatatagcggtgcgagcattaataatgtgtatctacaccaacaaacaaaatatcgttatgatcgttatcataaaattgaaaataagagattggctgatatcttagtcagctttgttaagaattatttattcgatcctaatgtggtttatccgcttgattccagtgatcgtcctaaaaccaaagaaattcgtcagtatattcgtaattttcgtaaatatcttgccggtgagggacagtattatgtggaatcttccgtgaccttaaatgacagtttgacgatttgtccattatttgggttaggtgcaaatcataatttacttaatcaaaccattgaagatttatttcaagttgttgaggataagttaacaatttgtacgccttattttaattttcctcgtttattacagcaaaaagtacgccgtttgctggctaaaggaaagcaagtagaaattattgtaggtgataaaactgctagtgatttttatattcctccatcagagccttttaaaatggcgggagcattgccatatctttatgagaaaaatttgcgtcattttagtaaaaaatttaccaagcaaattgaacaagggcagttagttgtccggatttggaaagatggtgaaaacagctaccatctaaaaggcatttgggttgatgattgttatatgttgttgacaggaaataatttaaatcctcgtgcttggcgtttagatgcggaaaatggcttatttatccatgatccgaaacaacagttacaagcacaaattcaacaagagttgacctatattcgtcgaaataccactgttctaaaacattatactgagttaagtgatctgactcagtatccgaagccggtacaaaaaatattgaaaaaatttgcccgcattaaagcagataagttagtgaagatgattttgtaagggttattcaaagcacttcatttcaaatattaaccgatagatcggcgataaatttcgccgatttcttttgaactcttaccaaacaccttttctaattgtgccaaaaaaagctcaccggcagatattgcatcaataagtgcattatgaccgatatattcgggcaaattatatttattacgaatatggctaagttgataattattttcgttgtcctgacataacgaacgttcaatttttaaggtatctaaccaaaacagaggaaattgcgataaattatagcgaacgttcagataatgtaagataaaacgcttttctatagtggagccgtgagcaataagaatacgtccttgcatcagctcaaagagtttattcattgtatcatctaaggtttctgccccatttagcatttgtggcaaaatatgattgataataacagtatcttctttaatttcttgttgctcggcgacgaattgatgccatgcttttgaaatatctaatgttaaattgtcaatgggaacggtagcaacactcaaaatattatccatcattgaattcagccctgtggtttcgaaatcaattactaagtaggaaagtgcggtcaaatctgtggaacttttggggtaaggcttttcaaataaccttttccattgcacgggtaaattatcttgattaataaagatttttcgctgtttttccaatttattcaacggatgaaatttgttgaggaaattttttatcatctcattattcctcgttgtgaaaaacgtatctctgccgcctcttgaaattgggcaattaagcgaaaagcatctttaaggtgatttcgttcaagggcacttaactcactgggatcgatatgattagttagttcttgctgttgttgcaaggcgtctgattgatatttaaaacgcatattgcagacaaattgatatacctccagtgcattattaagggtttctttattcagaataccttgcttgtaacaatgtctaaaacgctgttcagttgacatagtttgtgctaaaccggcagcaagtgcgtaaattcgtgcaagatctactaataaactgatagcacgttttttcaagttaagtttatttttatgttcaccttctttaataagaacaaaatttcggaaaatacttaatgggggttttactcgaatactgtttgccactaagaacgctaaaaagcgtttattgtgtgcgactaaatcgacaaaatattgctgaagttgatctgccaaattaagatcaccgtaaatacctcgcatatccataaatacagaggcattgagcaaaccttctaattcaggtgcaataatccaactacggaaattttctttccattcctgtagagaaacacaccagcgtgcatttattgccatatagttacccgtgcagtaaggatagccgcattcatgcaatccattgtttacaaatttagttagttgtacaaaatactcctgttcaagtgcggttaattttctttctaaaatgattgcattatcctgatctgataaagggtgcatttcataacgagcctgtgaacctgctacaacccaagcatagcgacaaggcggagttcctaatttatgttccgccatcatgagcaacttacgggcaaatgcatcagcgataagcgtcatcacgtgcataatattattataagcgacacctctctctagtaaagcacggaataaatcccgttgctgtttagctatttctacaagcaaaggcagcgtatttgcttgaaaaatacggttaatgataaaaacagattgcatactgttttgttttacaagatctgtggcggttaaaataccttgaactttatcatcaacaatcaccggcaagctacgaatattatgttgcatcatcatggaaatagcttgtagtactaattcatcacccctaatcacaggaggattaatgttcatgatttctgtcactaacgtatttacatctaagccttgtgctacaacttttttggtcatatcccgatcatgaataatgccaatcaatttgttttgttgcatcactaaagcagaagaacggcgttgttcacacattctaatcgcagcttgttgtaatgtcgtattcgtatcaacaagagcaattttaggattagcaatatcaatcacttttttcatgaaaatatcattttgattttttaaaaagttattttttgccaaactgtttagtctttttcctgcatcagaagaaaagtaagaagcgtactcaggaaatttttttaaaagttcatttaagcgttgaaaaggaatttgataaattaacgtattttccaacgcataagcctgatatttatcttgctcgtgatgattgaaaatactgaaaccaaaacaatcgccactttccaatcttgctcttaattgtcctgatttattgacttgctccactgatcccatacgcacaatatacaagttttcattattattgaggctatcgatttcatcatttgtgattagttcccctttggggatataacgaatttcaatattctgtgcagtaagacgaattaaatcatgaggtaaatgtgtaaaagggggaacctgtgcaataaataattcgatattgggaataagtgagctatccatgtgagacctttgttttatcgaaagtgagctacaactatagcagaaattaacccgacacagctgcatcgggctaattacatttagtatttttgagaagataattagtttttacgatttttccataatttaattaatcttctataacgctctgaggtttctttgatgagttgctcatcatcaattttaccagctaaccaatcagccgaaggttgtccaaaaattgttctgcctacagcaaacccttttactaaaggtgcgtttgccgatgctttaaacacattctcaaagactgcttcaggtgcgtctaagccaaggattaaaataccacgacaatgtttgtcatttttttcaatgacttgactgatgtctgcccaagtttttgcggacactccaggtaatttccaccaatccggtttaatgccgagagaatagaagtgggcaatcatatcggtgtagtaactttctttttgctccatatccgcaggcaaaatgatctctagtaataattcgtgacctgtacgacaacaagcacgataaacttcttttaatgttgcatcttgatctgcttttaactctgccttgtctgctggatgatagaacgctaaacatttaacgacatgttctgcgggccaactaatgagttgactacctaaatcaccatgctctaaacgcaatggacgagaagatggcatttctattggacgaccaatccaccattttttaccagtaatttcattgagtgcttcttgaccaaatgtggtatcagctaaaacgccggcattgccattataaatcccctctttttgagcggtttgttctgcggctttaagtaataacgttttgagtgttggaatacgtttcaaatctgcaccgcacttttcagccatatcaaccaattgtttacgatgatcaaaggcaaaaatacataaatcatgccattgttgcttgcgtgttgtaacacggtgtaaatggtttaattgttcgtctaagtccggtcgaggtaccgattccgcacgggagagataattatctaattcttctttagtcggcattgccggggcacaaccatggcgagagacgaccaacgcaccgcaagcatttgcataacgacaacattgctcccaactttcaccgttaatatagccacgtaataaacctgacataaaggcatcgcctgcacctaagacattcaaaacttcaacacgtacgccatatacattaataccaccgtcaatatgattcggaatatcgccctcaaagacagaacaacctaacgccccacgtttgcaaactaacgtagcgttactgactttacgtacattttttaatgcagttagcgtatcagttgagcctccggcaatatgaaactcctcttctgtaccaactaagacatcaaagtgatgtaaaacttcttgtaaagattgtgtaacggcttcagagtcaataaaacgagtttcaccatcacccaatgaagttaatccccaaagtacaggacgatagtcaatatccagtaaacgttttgttccattacgacctgcgtattcaagtgcggttaaaaccgcatggcgagtttttggatgggataaatgcgttccggtaatagcaagtgctttcgccgaagcaatatattcttcatcaaaatcatcagcggtgattgccatgtctgcacaattatcacgatagaaaattaatggaaaagtatcttgatcttttattcctaaaatcactagagcagtcagccgctctttatccgtaatcaaatggctcgtatctacacctagacgctgcaattcctcacgtaagaaacgtcccatatgttcatcacctacacgagccaacatagatgattttacaccttgtacagctgtcccataagcaacattacctgatgatccgccgagatatttagcaaaagagctcacatcctctaagcgtgaaccgatttgttgagcatataaatctacggcaactcgtccaagacaaataagatctaatgttttttcttttttcattgtgcttctccttgcgtgatgaagtcatcacaaaaaacggatatagaataaattattgtcttaaattgaaacatatatttcaaaaatgtctagaaataaaattaatatttgagatattgatcacaaagattagctatctcgctggtatataaagtcttttaagtaaaataagaatgaaatttccttttcaaagtggtataaatttaacttattactgagagaaatacaaaggaagagatagtatgcaagaacattctcaactcgttacattacaaaatgaaatccgttcacgttattcgactttgagtaaacgtttgaaacaggtagcacaatatgtccttgataatcacaatagcgtaatttttgatactgttgcgacgatatctgaacgtgccggtgttcctccttctacgcttattcgcttcgcaaatgcgtttgggtttagtggctttaatgaaatgaaacaaatttttcgtgaaaatttgattgaagaaacggcgaattatacggagcgtttacaagttttccgtcagctggaaccggaaaagagcgagcaacataatctgcaagatattttgaatatttttgcacaagccaataatcaagcactaaaacaattaagtagccaaactactacaaaacagttaaaaagtgcggtagaaatattaaaaaatgcacagaatatttttatcattggattaaaacgttcgtttagtattgcctgttatttggattatgtgttgcatcatttagattgccgttcttttttaataaatggattaggcggtatgtttgatgaacaattaatgcaagtgaaaaagggtgatgtcatcgtggcggtgagtttttcaccttatgccaaagaaacgctggaaattgttagtgcaacctcacaaaaaggtgtcaaacatattgctatcactgatagtcaaattagtccattaattgcctccagcgatgttgcttttgtcgtgaaagaagcacaggtaagcggcttccgttcacaatgtgctacgatgacattggtacaaactttggcgattttattaggcttagaaaaagagaaagaaacacaaaattcttaaaaataacgattaagacttggtgatgaatgtcagcaactaagttttgagataaatatcaaaacgatgatttttggtttggtgactgaagtgcggtgtttttttagcaagaaaatctgcgtaatcgggacgctttactaccgctcttttttgtgcgagcaataaggcaggttctaataacatatcagcatccaaatctgcaccgattaaatgttgaaaaatacgcatttcttttttaaccaatgcacttttttgtttatgaggatacatcggatccaagtagacaacatcagcaccttcttcactcgaatttaattcttgaatatgtgctatgtccagcaattgcatattcgcctgcatcatagtccctatttccgcatcggcataagcacgcttcaagccgtcttgtaataacaaatggactaccggatggcgttcaaccaaacggactttacaccccaaagcagccagcacaaaggcgtcacgtcccaaaccggcagttgcatcaataactgtcggcagataattacctttgatccctaccgcttttgccacagcttcagctcgaccgcctccaaatttacgacggtgagccattgtgccggtcacaaaatccacataaacagcaccaagtttcggctcatctaatttgcgtaattccaagcgaacctgtccttccacttttgtttgcaccagtgctaaataactattaggatcgtgaatcaaacctttttgttgacaaagtgcggtaaattgcaccgcactttctgtttcacaaattaattggattttttgattaaccatacaccactttccatatgctctgtataagggaattgatcaaacaaggcggctttttcaatacgatgagttttagttaattcttgtaaattttcacataatgtatatggattacaggatatatataaaatccgctcatagttttgtactaattttactgttgccatatcaagtccagatcttgggggatcaacaaaaatggtattacattgataatcttgtaaattaatgccttttaagcgattaaatgcacgcacaccgttcatagcttgcgtaaagtcctctgcggacatacgaataatgtgtaaattatcaattttatttgctgcaatattaaattgagccgcacttacagagggttttgcaatttctgtcgctaatactttgcgaaagttttgtgctagggcaatagagaaattgccgttcccgcagtaaagctcaagtaaatcgccctgactatttttagtacaattaattgcccattccaacattttacaatttaccgttgcattaggttgagtaaagctgttttctacttggcgataaatatactgttgatttttgacaggcaaaatttcatcaacaaaatcttgctgtaaacaaattttttgtttatttgcacgaccaataatttgtacatcaaatccttgttttatcagttgttgtttcaattgagttgctgcctgtagccattcttcgttaagtgttttgtggtataacaaactgacaatgatcttgttgctcaaagtactgagatagtcaatttggaataagcgatgagttaaaatattgtgttgtttaagcaaaggcaataacgccagcatcatttggttaatcaactgactggcaataggaaattgatcgatacgaaaacgttgttttgttttttgatcaaacataatatgatagaaatcatcttgttcatgccaaatacgaaattcggcacgcatacggaaatggcttgtttcggaagcaaatacgtcaagcggtggtgaattaaaaggtgctagaagtgcggtcagcttttgttgtttttctgctaaaagtgcggaatattgttcaataggtaaacgttgcatgatcttcagtattgagctaaaaatgaaaaggtgcgaatttcgcaccccttttacttaatcttaagttattcggcagagaaatcatccggattgtcagcaccaacaacgccagataatgtgtaaacacgtttactggcagaaatacgagtgcggtatttattccaagttttctcaaaatatgtttctgctggacgttctccacgacagaaagcaacgaaagctttttcttcttccgtaactggtacacgctcacctaaatctaacgctttaaatgcttgaccatattgctctaacgtttgagattcacgaatggtgtaatcaccatgacgagcaaaacctcgtggataatttttatcatcgaaaaaacgacgtgtaacactaaaactctctgccataatatcctctatcttattttgtaaaaatcggctcgcattaaatcaattttttgttatttttgcaataaacctttaacagtttctacataatccttgataaaaccgtctgttgtacgggatagaccttccgcatttactttatatttaccgttaatataaaattcaggtgttgctcttacgccaagtttttttgctaaggcaatttgtttgtttgtttgagcggtgacggcaaaactattaattcctccgtcaaactgtgccgcagtaatgccgtttgcgagaaacacttcacgaatattgtctaaagtaggtgcttttcttttttcaataatcaattcaaatagaggcattttaactttttcttctatacctaagagaattgctaacgaccaagcacgaacaatatcttcgcccatccaatcaacatgatattgtttgaaagtgacatctttgggcaaatcagctttaatttgttgtggaatttgatatgttttttcaaaattaaaacaatggatacaaccaaaagagaaaaattcaatcacttcaggttgaacggaacgaggctgctctagttcaatatactgttttccttcttgtaatgctaaggcttgagttgaatttaaaaagaaaaaagaggctaatgcccatagaaattttttcatgtaatactcctaatcaataatgccacgtgcttttaataaggctgttttaaaatcgtcttcataatcttttttgatgccgggaataggctcatttttacctgtaccatacatttttaggtgataaataataacctcatcggttaattccgcaatgggcttatcaaaaccggtttcctccgcaattttttgtaaaacttggattaaatgtaaatccggattgttagaccaatagggctgtaaaagttccaacacttcgtttaaacgatgacatttcataaagttttccttattatttaacccaaacagccgacaatcatacttgaaataggtaaagaagaaaatatggcaacaacaattagtgcagtaattttagctggtgggcaagctaaacgaatggctgggttagataaaggattacaactgcttcaaggtaagcctctctatcaacattgcttgcaaaggttaaccaatcaagtgagtagtatttctattaatgctaatcgtcatcaagctatttatcaacaaagtggggtagaggtttttggtgatgaattggaggattttcaaggccctttaagtggaatattgaccgcacttgagcgagctaatacggattttgtgctttttgtgccttgtgatagcccttttttgccgttgaatttatgtgaaaagttgcaaagtgcggtggagaattcgaaaagtttattagcttatgcaaatgatggtgaacgtgaacatcctgcttttagtttattgtccactcaacttaaattaccgttaagagtttatttgcagtcaggtcatcgtcaaatgttacaattttttcgtcaacataaggctatttctgtggatttcagcttacaaaaacaggctttcgtgaatatgaacacattgcaggatattgaaaaatatcaaaatatttatgcttaattttttgttttaattattaattatcttaatttgagcataaatatatgaaaaatcattttttttactaagcaattagagtagacttcccctccgttgatatattacataggaataaaaaatgttaagcaaacaacaatcattaaaagaactcacatttcgaggaatgttattgggggcgttgatcactgtggtatttacggcttccaatgtgtatttgggtttaaaagtcgggttgacttttgcctcatcagttcctgcagcggttatctcaatggcagtattaaaatttttcaaggggtctaatattcttgaaaataatatggtacaaactcaagcatcctcagccggaacattgtcttccgttatttttgttatccctgctatgttgatgctgggatattggcaaggtttccctttttggcaaacattattaatttgtatttccggcggtatgctaggggtaattttcactgtgccgttgcgtaatgtcatggtagtgaaaagtgatttgccttaccctgaaggcgttgccgcagcagaagtattgaaagcgggtaatgatgaaatcggtggaagaggtgtcaaagaacttacaatcggtggtctgattgcagcggtagccgggtttttaactaatggtttacgtgtaattgcggatagtgcaagtctttggttcaaaggtggaaatgcaatttttcaagtgccgatgggtttctcacttgctctgttaggtgcggggtatttagtgggtatgattggcggtttagccattttattaggcatttttgttgcttggggagtagcagttccttactttacttctgtcgcacccatgccgtctgatgccgatatgataggttatgctttcagtatttggaaaaataaagtgcgttttattggtgtagggactatcggtattgcggcaatttggactttattggtgttaatgaaaccaatgattcaaggtatgatcgagtcatttagagctttgaaagatccgaatgcaaaaaatactgaccgcacttcccaagacttatctccgacaacgctgattttcaccacgttagtaagcgttgtattaattgtattggctttatatagctttataaatcctgtgggtattgaagccggcacggcgatcattttaattttggtttgcactttacttgctgtcgttatcggtttcttagtagcagcagcgtgcggatatatggcaggccttgttggttcatcatcaagcccaatttccggaatcggtattatttctgtggtaacaacttcattagtgttaatgctcgtcggttctgctacaggtttattagacacggcggaaggtcagaaatttttgaccgcacttacgctatttaccggttcaatcgtggtttgtattgcggcaatttctaatgataacttacaagatttaaaaaccggtcaattggttgaagcaacaccttggcgtcaacagtttgccttgattatcggtgtgattgtgggggcgttggttattgctcctgtattggaaattctttatcacgcctatggttttgccggtgcaatgcctcgtgaaactatggatccgagccaagcacttttcgcaccgcaagcaaccttaatgatgactatcgcaaacggtattttttctcataatctcgaatggaactatattttctttggtatcggctttggtgcggttttaattttcatcgacagcgtattgaaaaaggcgtctaacaaacgtttagcgttaccagcattggcagtaggaatggggatctacttaccgccgtcagtcaatgcaccaatcgttgtcggtgcattgcttgcttggttgattaatcgtcatttagaaaactttgcgaaacgtacaggcaaagatcttgctgatgtgaagaaaaaagcggaacgtttcggcacattatttgcagcgggtctgattgtgggtgaaagtttaatcgggatattactggcatttattgttgcaggttccgttacttccggaggttctgatgcaccgctagcattacatttagaaaactgggagagtctagctcaagtattaggcttaatgatgttcgctacgggtataacaatctttgcattacgtgtactcaaggcgaaacaataatattgagaaaattaaatagatatttacaaaaaacctccagctttttaaagcggaggttttttatacataatttagaaacgagaaaactaagtaatattcacttcataacaatacctaacgattaacgcacaccctgtttatctaatctggcgaaatctttacatccctgagcgttgccattatcgcatgcttgaccgtagaatgctttagctgtagaaacatttttttgtgcccctcgtcctttttcatacatatcgccgagatagagttgtgcttctgcaatgccttgttcagcggcttttgtgaaccaatagacggcttgttgatagttttgagcaacgccttgtccgtttgcatacatcacgccgagatagagttgtgcttctgcaatgccttgttcagcggcttttgtgaaccaatagacggcttgttgatagttttgagcaacgccttgtccgtttgcatacatcacgccgagatagagttgtacttctgcagctccctgttcagcggcttttgtccaccaatagacggcttgttgagagttttgcgtaacacctagtccgttcgtgtacataaagccgagcatagattgtgcttttgcatctccctgttcagcggcttttgtgtaccaatagacggcttgttgagagttttgtgtaataccctgtccaaacatatacattgtgccgagcacagcttgtgcttttgcatttcctttttcccccagttgtttgagtaagggaaaagcggcagaataattttgttgtttgtaaagttgagtagctcggtcaagtttttcgctattggtttcggcaagtgcagattgggcaacaccgaaagagagcaaggcgataagtagggatttttttaggttcattttatgttccttatttgacgattatttgaattcaatacacaaagtttgtggattgagaaaacattttcttcccgtttcaagaggggtgattggattcaaaatatttaaattagaatcaaataattgagagctgccattagcaatcattttattgacgatttcatccacctctttttgttcattaggattgatggcttttatattgtcgtaaacataaggcgaatctgaggtatctccaaaaaaattcttataaatatcaacagtaatttcaatacgatttgacatggttttttcctctgatttgattttatatgtggcgttcgatacctactatcaagtaggtaggatgtagagtatactctacatcctttgacgtcctcccctagctaaagcaaggagattcctaccagctcccacagcaagctgtgggctactctcggagggtttctgctgctgaccgccaatgcgattcacttcacagacgctacgggcacgtcctgccctgattatgccgtcattgagagtctaaagcgacctctgttagcagtaagaagtatatcatatttatgccttatatccacgccctaaaggacgtggttttacggcacgattagataaaggattgctaaaccctttgctcggtgtcgattggtctattgagtgttatttatacagcagtatattaaaaaacaactccggtttgaaaaccggagttttttagaggtattaggcaaaagtatctaaatattgatctgttatttgggagacttatttgactagcccgccacttgcttgtaagtcagcatgatacgaagaacgcacaaaaggtccgcaagcggcatgctcaaatcccattttttcggctttatcacggaaatcatcaaattcctcaggtggaacgtatcgggcaacaggtaagtggtggcgacttggttgcaaatattgacctagagtcaacatggttacaccgttatcccgtaagtcctgcattacctgtaaaatttcttcattggtttctcccaagccaaccataatgcctgatttggtagggatatgtggaaaaatggttttaaattctttgagtaattttaacgaccaattatagtccgcacctggtctgatttcacgatataaacgaggtacattttctaaattatgattaaaaacatcagggggattatcttttaatttttctaatgcttgctcaatgcgtccacgaaaatcaggcaccaaaatttcaattttaatacctggattaagtttacgaatttctttaacacattcagcaaaatgtcccgcaccacgatccggtaaatcatcacgatccactgatgtaataacgacataacgtaatttcatatcttgaatggtttccgccaatttttttggttcatccggatctgggggtaatggttttccatgggcaacatcgcagaatggacatcggcgtgtacaaattgcacctaaaatcataaatgttgctgtgccgtgattgaagcattcatgtaaatttggacaagacgcttcttcacatacggaatgtaatccatgacgacgcattccgtttttaatactgttaattttcgcagaatttgcaggaagcttgattttcatccattcaggtttttttaataactcctgatttggatcgatatttttaaccggaatgattgacgtttttgcagcatcacgatatttgacaccacgttccattttaaaaggggttgtcattaacagatcctaatttgttaataagttgttacatcattatagcccaataattgcgtaaagtgtgtaactaatttgggtgcaactttatcacattgagcttgttcagtgggtataaaatctgccatttggcacatttctaagcctatatagccacaaggattgatttgtctaaatggcgataaatccatgttgatatttaaggctaaaccatggaaagagcagcctttacgaatacgtaaaccaagagaacaaattttttgttcatttacatatacaccgggggcatcagctttcggataacttttaataccataatcagccagtgtgctaaccactgattgctcaagagcggtaactaattgacgaacattaagttcactgccgtttgctttgtgacgcttaatatcaatcagtacatacataatttgttgtcctaagccatgataggtaatttgtcccccacgatcggattgtactacaggaatatcggttggattgagcaaatgttcaggtttacctgcttgtccttgtgtaaaaacagccggatgttgaactaaccaaatttcatcagctgttagcacatttcgagtatcagtaaattctcgcatttgttgccaaacttgttgataatcttggattccaagttggcgtataataagagtagtatctgtcattttctgtcttaaagtaccatgcgtacaccatcaattttggctagttcagtatagagaatttctacttgttcaatattttccgcaatgatatctacagaaattgaattataagttcctttgctactgatattttgacgagggttataatcacccttagcgtatttttgcgttaccataactacatcatcaattaaatctgctcggtttttaccaacgactttgaaagtaaaagagcaaggaaactccaacaaatcttttaattgtttttgtggaatgtcgttaagttttactgttttgtcagtcataaaatttccttaaagtgaaaatatgccggaaagtgcggtctgatcttattgtttttagttaaataaaccttttactgttaataccagccagtcccaaagtttgctgaaaaatccgccttcttgaacttcagacataatttttaagtttgcacttgcaatatcacgaccatctaattgataaataattttacctacaatttgtccttttgctaacggagctgttaacattttttgattaagctcgtatcttgttttaacatcattctggcgaccttttggtaaagttatataagcatcttccagcaccccaagttgcactttgtttgtattaccgtagtaaactttttcttctacaatagattggtttgcctgtaaagatttgaaggtttcaaagttcgcaaagccccattgtaacaattttttactttcaatttcacgacctttgtgagtagcaacgcccataacaactgaaattaatcgcatattgttattatttactgcagaggcaaccaagttataacctgctttatttgtatgtcctgttttcataccgtctactttgattgatttatcccaaagtaaaccgttacggttatgttgcttaattttattgaaggtgaattctttttcagcatagattttatattcttcaggcaggtcatgaataatatgacgcccaataatcgccatatctctggcagatgaatattgattatcatcatccaatccatgaacggtcataaagtttgtattttttaaaccaaatttagcaacatatttattcattagttcaataaaattacgctctgaacctgctatatgttccgctattgccacacaggcatcattaccggatacaatcactatgccacgatttaaatcagctactgatacttgttggtttaaatttaaaaacattttagatgaaccgggaaaattttcccccaagcactttcatcaatggttacagtgtcggttaagctaattttaccttgcttgattgcatcgcctacaacataacttgtcatcatttttgttaatgaggcagggtgttgacgctgatccggattaaaggcggcaagaactgcacctgaatggtaatccatgagaatatagctttgtgcacttaattccggtgaagcaatgccatattgaatatcttgggaaagtgcaggtaatgaaattaatcctgacatcagtgcaatttttgtttttttcatcgctttttgtaacattttacatcctttaaaaattatttctcattgtaagagatggtgataaattagtgtaattggcggatttatttaacctatctttaaaaccttattgctaagatttaatgtttttacgtgttttagccaacgtttttgtacccggtccggaaatttttccataagcatcaacatataatgattctacctttacttttgctatgccggcatgaatcattccaagctcttttgcggcagcttcagataaatcaataattcgtgctttgctaaaaggccctcggtcattgattcttacgatcactttacgattattgcgtaaattagttacgaccacataagagtttagtggcaaagttttatgtgctgctgtataggcattattattaaaaatttcaccgtttgcagttttacgtccatgaaattttttgtgataaaaacttgccattcctttttgtgaataattttttgccttctcgtagggtagtgttgtatatctaacgcctttgactacgtaagtatagggctttttactcagtttttgatagactggcttagctccttcaatgccatataattttttcgtatccgcctgtattgatagcgaaactaatgccataaaaagtgcggtgcataatttaaatattttgtttgacttcatagtaataagtttaatattgattgtattatctaagataaatatttatttagttcctttgaaaaagttatttttatgtgtatgaatggacatgatcaaaccaaatccagccattaaggtaacaaaagaggttcctccatagctcattaaaggtaaaggtactccaactacaggtagaatgccacttaccataccaatattgacaaatacataaacaaagaaaattaatgtcaatgcaccacttaaaattcgtccaaaagaattttgtgcattaacaccgataattaaccctcttgcaacaataaagagatagatgagcattagtattgtaaatcctgtcataccatattcttcacttaatacagcaaaaataaagtctgtatgtggttctggtaggaattcaagttgcgattgtgtaccttgcatccaacctttaccccaaatcccccccgaaccgatggctatttttgattgcataatgtggtagccagcacctaaaggatctttttctgggtctaaaagagttaagactcttgtgcgttggtaatcatgcattaaatagagccatacaattggagtaaaagcagctaagcccacaatagcaattaagatgaaccaccagttgattccggctaaaaatacgacaaaaatcccggatgcactgactaaaattgacgttcctaaatctggctgaatagctactaataaagtcggcactattattaataataaagcaataaaaatttcacttaatttaggtggaagaggacgttttcctaaatatgttgcaaccattaatggtactgataatttaacaatttcagagggttggaaacgaaaaatccctagatctaaccaacgttgtgcccctttacttgttgttccaaaaagatccactaacagtagtaaaattacgccaatgacaaatccataaggtgcaatacgttgataaaaccttggtgaaaattgtgccatcacaaacataacagtaaaaccgagagcaacctgaataattcggttgcggaacattttttcactgcctcctaccgcactataaagtacaagcaatccataggaggaaatggttactaaccctagaaaaagccaaaaatcaatatgcaaacgacgccacaaaatcagccaaatattttttttctccatcaactttttcctttttcatttttcatttttcattttgtgattgtacttgtggcaaacggatatttaaataatagtccataatttttcgaacaacaggtcctgccttactgctaccaccaccggcattttccaaaataacaacaacaaccattttaggattgtcataaggtgcatatccgatgaaccaagcatgatcgtgcaatttattatcaagttcgtttgcattgtaagtttgattttctttcaggctgaaaacttgagctgttcctgattttcctgcaacaggataactgacatcaataaaagatttacgtcctgtaccattcggtgcgtgtattacattatacatgctttgttttatcgtttcccaaaataccgcttgaggttcagtaatatcttcgtaaagacgaggatcttgatagggttgcatttctgacccttcaattgctttcattaagtgcggagtattaaccttgccattattaactaaaactgcagttgctttggcaacttgtaatggggtggctgtccaataaccttgaccaattcctacagaaatagtatcaccctgaacccaaggtcgtttgtagcgtttttgtttccattcccgacttggcataagtgcggcggtttcttcttgaatatcaatacctgttggcacaccaaaaccaaagcgtttcatccactgagataaacggctaatgcccatgtcgtaagcaagttgataaaaataagtatctgaagattctactatagctttattcaaatcggtgtagccgtgccctgattttttccaatctctaaaacgtttggtggtattaggtaaaatccaatatcctgggtcaaatatcgtagtatttgtggtaattaaattttcttgcaagccagcgatagcaacgaaaggttttatcgttgaagccggtggataagcaccttgagtaacacggctatacaaagggcgattaggatctgtcagtaattgcttgtaatccgcacttgaaataccgccaacaaaaagattgttatcatagctcggggtagaaaccattgctaaaataccgctatctttaggatctaatactacaactgctgcacgaagattgcccaataaatttgcgatataacgttgtaattctaaatcaatcgttaagtgaatactttttccggcaatagcaggctgttcccttagtttgcgaataaccttacctctattattcacttcaacttcttcaaatcctactttgccatgtaagtcatcttcatagtaacgttcaataccgagcttgccaatatcatgagtgccggcgtagttggcgtatttttcatttttctttaaacgctctacatctttttcattgattttagcgacataacctagaatatgagtcaacggctcaccatacaaatagtggcgtttaaagtaaggcctaatatcgaggctgggatagtgatattggtttactgcaaagcgtgcgatttgttcttcgctcaaatctcctttaaggagaattggcatatatcgggatgagcgacgacgttcctttttaaagttctcaatatcgtcatcatttaaaccaacgatatagcgtaactcttcaaaagtgcggtttaaatcctcaactttttccggcacaatatataagccgagaaaggtaatattttccgctaataatttgccgtagcggtcgtaaattagccctcgagtcggtggcaaaggaagtaatttaattcgatttccgttagatcttgtctggtaagtttcgtaattgacaatttgtaaataatacaaattggtaaataaaagtgctgataaacccaatacacctagaaaggcgataagagcacgacgagcaaaaaggtttctctccgcctttttatctcggatcggtgtttgtaggggttgagagagtaatttttttaaattcataaaatattaaccgcacttattctcggtgataaggatgatttgtgcttaacgaccaagcacggtataaactctcagccacaacgatacgtaccaagggatgaggtaaagttaaaggcgaaagagaccaactttgttctgtcgcagctttgcattcaggtgataatccttccggaccaccaattaagagtgcaacatttcgaccgtcatgtttccatgcttctaattgctgtgctaattgctcagttgtccaaggtttaccgggaatatctaaggtaataatacgacttttctgacaagcggataacatagctttaccttcttgttcgagaatacgtttaatatccgcattttttccacgttttcctgccgggatttctattagctcaaaaggcatatctttgggaaaacgacgttgatactcctcgaagccttttgtgacccaatcaggcattttagtgccaacggcaattaattgaattttcatagattaataagtgcggtcattatccccaaagtttttccagctgatacatttcacgactgtcagcctgcataatgtgtacaatggcttgaccaaaatctatcgcaatccaatctgcggtagatttgccctcttcgccaaaagtatcaatgccggcttgcttactttcatcaattaatttctgtgccaaagagattacatggcgacttgacgttcctgtacataaaatcatgtgatcggtaatagaagatttacctctaacatcaagggctaaaatatctgtgccttttaaatcatctaatttactcactagaaaatcgactaagttcattttttctcttctcaattgcttatggttatttgcttaaaagtgtgtaatgttagcatgatttgggggagctaggaatatcgtttgatagtgtaattatatacaaagaacgctcttttacttatataaaaaatttttctgtttataaatgatttctcggacagcgattggaagagatgagcgtttatttattatttaggttcacaaaaatcttttatgtcagtaatgccacatacattgaaagcacatctgtattggttttcactaatgttctttataaagaaactgcacctattaatggtacagttgtgttttgtcaaaaatacaaagtgataatgtgtaattctaaatttttctaaatattaactacacgcatcgcgatatatttactataacctaaggcacataaaaaaaggcttgcttgaagtaagataatacaaggtcctgtggcgacgttgaaatgaaaactgagcaatacgccaaaaataccactgaatactgctgtgcaaacggcaattagcatcatataatcaaagcgtttagctaaaatatagcctgttatcccaggtgtaatgagcattgccaccactaaaataacgccaacaacttgcattgcactgatgatgactaacgctaggattaccagtaaaccatagtgtaaaaatttggtgttaagtcctgcaactcgtgtgtgacttggatcaaaacagtaaagcaacaagtctttgcgttttaaggcaatcaggataaatgccagtaatgcaatgccaatactttgccaaaattcttgcttaatgatgcctagaatatttccgaacagaatgtgcattagatgttgatcggtttccactttggaaaacagcaccaaaccgaaagcaaacattcctgaaaaaacaattcccatcactgtgtcttctttgattcggctgttatctctcaaataacctacggaaactgcacaaaagatgcctgcccaaaatgccccaatcgcaatcggaattgctaatacataggcaagaataattcccggcaatacagcgtgagaaatggcatcacccattagtgaccagcctttaagtactaaataacacgataaaatcgcacatactgccccaatgataggtgcgatgataatagcttgttgcataaatggatacaccaagggctcggtaaaccacgctacaatcgtattaaacatttggcttctcctgatttgcaagatttggtgaggaagtcactgctttttgtgtacttcgcttacgtggaataagaccatatttgggagcaaaaaagaaagcaagtaagaagatgaacgtttgcaatgatacaataaagccaccagttgcactgtctgcgaaataactcaaatatgctcctagtgagctagtagtaccaccgagtaaaatcgaaataatcaacaggcgatcgaagcgatcggtgagcaaatatgctgttgctccaggtgtaatcaccatcgcaattaccaaaatagcccctactccttgtaaggcggttacaatgcatgcacttaacaaggtaaagaataaaattttgaattttaaaggcgatagccctaccgctttggcttgaatttcatcaaagaacacaagcattaggtctttccaaaagagtagcaacaatacaaatgatataccgagaataatagcgacttggatcatatcttcatcggcaatacctaaaatattgcccaaaacgatagattgtacgttcacggaagtgggattaattgaaataatcaacaatccgagagcgaagaaagaggtgaaaataaaaccgattactgcatcctctttgagtttagtcacgtatttcactgctaaaatggcaatagtggcaagtagcccagagaaaaaagccccgacggcataaggtaatgccaaggcataggcaatagcaacgcctgggacaacggcgtgggataacgcatcaccgatcagtgaccaacctttcagcattaaataagcggaaagaaaagcacaaaccgctccaatggcaccactgaccacaatcgccttaaacataaaatcataagaaaacggctcaagtaatagctctaacatcgcattactccgcatcttgaataaaatgttgataacgtaaaacgccaccaaacacacgagttaaattttcttgagtaaaagtgctttcgattgatccagcagcgagtagtgtacggttgatcatcaccgcttgatcgcaaaaacttggcacggtgctaagattatgcgttgagacgagaacgagatgaccttcctgacgaagctgtttgagtaacgcaatgatggcattttctgtgccaacatctacaccagtgaaaggttcatctaataaaatgatttggctttcttgtgctaatgcacgagcaagaaatactcgttttttttgccctccagaaagctcgccgatttgtcgatctcgcaaatgagcaatattgactcgctccattgcgtctaaaacttttttcttgtcttgtgctttaggcatacgaaagcaattcatataaccataacgccccatcattacaacgtcataaacagaaacggggaactgccaatccacttcttcactttgcggtacataggcaactaagttttgttttaatgcctgattagcgggcatgttacaaatttcaattgaaccttgaggcttcactaagcccataatgcttttgaataaagtcgattttccacttccgttaataccgagcaatgcacaaatcgtaccaccttcaaggtggaaactcacatcgtgcaacgccgtatgaccattactataacgaaccgtaatatctctgacagaaagagaactgatgtgagttttcattcaattaccttattttttgaaaccattcacaatggtcgaaacagttacatttaataagtcgatgtaagttggtactttaccatcttttgtagaaagtgaatctacataaagtacaccaccgtattttgcattggtttctttagccacttgttttgctggcttatcagaaatggtgctttcgctgaacacaacagggattttgtgttcacgtacttttttgattacatttttgatttgttttggtgtgccttgttcttcagcattgataggccataaataaagctctttgaaaccgtagtcgtgagctaagtagctgaatgcaccttcactggttactaaccaacgttgtgaagctggtactttttctaactcggcacgtaatggtgcgtctaaagcaacgattttatctgcataggcttttgcattagcattgtaagtgtctgcatttttaggatcgtatttcactaaagcttcacgaatgttttcgatgtataccaaagcatttttggttgacatccaagcatgtggattcggcatacctttgtatggaccttcgtagatagaaattggatcaatccctttagttacaacaacagctggtttatctttcacttgggtaaagaaacgctcgaaccaacgctctaaattcattccattccaaagcaccaaatcagcagattgtgcttttacgatgtcttgtggagttggttcataatcatgaatttctgcacccggctcagtgatcgactcaacaacagcagcatcaccagcaacattctgagcgatatcttgaataacggtaaaagtagtaactactttaaattttgcgtaacttggtaaactgaatacagaacctaagattacacccataacaataagtaaacgtgacataatttctccttcgaattaatattagaaacaaatttgcatttcaagcaaactcggtcttgcatagtactgcaaaaataacttgttgtaaatagcaataattatcaattaaagacattttattggtttgggtaaaccagctaattttgaagcttgttttgcgggaccttctgggaataaacgttgtatgtaacgactattgcctttatctgcacctagcttttgtcccaatgctttgactaacattctcattgctggtgaggttttatactcttgataaaaatcccttacaaagttaataatttcccagtgggcttcggttaattcgatattttctgattttgcaatggctatagcgacatctttattccactgattcatatctaatagatagccctcaacatcagtttcaatttgaacttggttaacacttaacatatgttactatttttgtccttttgatatataaaaagtaaaaagcccctattcaaggggcataaaacaagtttaatcaattattcatcacggttgaaaatacctagtaaattgagcaagctgacaaaaagattgtaaagtgaaacatacaaactaaccgtagctctaatataattagtttctcccccatgaatgatattgctagtttcatataaaatagccatagttgagaaaacgataaataacgaactaaatacgatgtgaaagccactcatattaaagaagaaacttgctatcatgcctataaccaatacgataaagagagcaagcatcatgccggataagaatgacatatctttttttgttgttagcacataggccgagcatgtaaaaaatacacttgcagttccggctagagcaagaacaaccaaatcacctaatcctgagccaacataatagcttaaaataggacctaaagaatagcctaataatcctgttaatgcgaatgtagataaaagtccccaagcactgtttgctaacatattattgaggaataataatccataaaaacctatcaacatgacaccgaaatgaagtggagggaggtttaattgcattgcactgaaggcgacaacagaagaaaaagccaatgtcaatgctaataaaaagtaggtgttacgtaaaaccttatttgttgccagtaccgattcttctttagtatcaacaataaaacgagattgcataaaagctcctaggttgtagttgtaaataaaaagtgaaaagctatttataagttaatggttagcaactttaatgtcaacatgaatatttttcagaaaagagtaacattgaagtaaaattaagtaaaaatggataaattatcaactcttaaaccataactgttatttttttagtttacttctatttctatctatattatattacgcctcgtcaagacggaggaatggtcgagtggttgaaggcaccggtcttgaaaaccggcgagggtttacgccctccgtgagttcgaatctcacttcctccgccatcaagttttactaagtcgtaagttatgcctctgaaatcagtaacttacggcttttttatatcaggttaattgtcgtaataacttgcttaaaaatcaccgcacttattggtctgatagtttccgtagcaaacgatccatggctcgatagcttaatgcttcagctaagtggttttgtttgatatcagaatctccgtttaaatcggcgatagtgcgtgcaacttttaaaattcgatgataagcacgaacagataaaccgagtctggttaaagtattttctaaaaatagtgcatcttgctcagtcaacttgcaatctcgctcaatttctttaccggttaaataagcattgacttttccggctctagctagctgaatttctctgacccttaatactttttctttaacttgtgctgttgtttcacctcgatcttcggtattttgcaaagcaccttgtggaagtaaaggcacttcaatggaaagatcaaagcgatctaaaaaaggaccggaaagtctgttcaaataacgcaacacttgttgtggtgaagtgcggttgtgtataccggtataatgtcccgttggacttggattcatcgctgccactaattgaaaacgtgccggaaactgaatttttgcattcgcacgtgaaataattatttctccgctttctaaaggctggcgtaaagcatccagcactctccgttcaaattcgggtaattcgtctaaaaataatacaccgttatgagccaaagaaatttctcccggtttcggaattgttcctcctccaaccaatgctggtgatgaggcactatgatgaggtgcacggaaaggacgttgtttccaattttgaaaatttaattcgttttgtaccaaacttgttacagaggcggtttctattgcctcttgatctgtcatatccggtagcaagccagttagacggcttgctaacatggttttacctgtgccgggcggtccgagaaacaacaaattatgttgtccggcagctgcaatcattaaggctcgtttagcatgttgttgaccaataatatccgtcagatctttattagattgaggtgaaaaatccaccgcactttgcatacataacgttgtggatgaaggtagcgaactgtcgtcattcaggaattgtacgacctccaataagttccgtgcaaaaaatgtttcgtgttgtgaaactaaagaggcttcattagcattttgttgtgcgacaataagttgacgcttagatttttgccccgctaaaatagcagggatcacaccgtgtacgcctcttaactcacctgtgagagccaactctgcaacaaattcaaattgttgtaacttttttgcattaatctgttccgaggccgctaagatgccgagtgcaataggtaaatcaaaacgccctccctcttttggcaaatctgccggagcaagattaactgtaatgcgttttgctgggtatttaaattgagcattgagtaatgcactacgtactcgtccttgagcctcagttactgttttctccggtaatccaacgagggtaaaagcaggttttccattactcaagtgaacttcaattgtcaccaaaggtgcttgtacgcccattgatgctcgactataaacaactgctaatgacataatttctcccaaatttttgagctaaaatataaaaaaagcagcgagtaaactgtacttactcactgcttttttgcgatccggatcgtaaaagtaaaaaagttttagctaaaaagcggagaaaaccactgatctaatttttcggataagcgttcgataccgattttattttgtgcggaaaaggcttcaacttgtacatcaccttggaaaggtaaaatcgattctcgaaccatttttacttgcttacttctcgcactttgactcaatttatccgcttttgtgagcaataataaaaccggtaaatctgcggaaaccgcccattcaatcatctgttgatcaagatcttttagaggatgacgaatgtccattaaaataaccaaaccacctaaacattcccttttttgcagatactcacctaaagatttttgccactgaagtttcatttgttcgggaacagcggcatagccatatcccggcagatctaccagcttacaattgggttctacttgaaataaattgattaactgagtacgtcccggtgtttttgaagttcttgctaaatttttttgctgggtcaacgcattaagtgcggtagattttcctgcattagatcgtcctgcaaaagcaatctcaatcccactatcctcaggcaatacctggatattaggtgcactcattaaaaaatgggttttatgataatttaattttatgtttgtcattttattttcgcttaggtcgttgccaattggaaatatggcgttgtggaacacgagtaataaccaactcattttcttgtacatctttggtgacggttgttcctgcaccaatcgttgcaccgcttgcaattgttaatggtgcaactagctgactatcggaaccgacaaaaacgttatcgccaatcaatgtcttaaatttattggcaccgtcataattacaagtaataacaccggcaccgatattacaatgatgtccaacctcagcatcgccaatataagtgagatgatttactttagaccccttgccaatttgtgcttttttgatctcaacgaagttacccacatgagtattttcgctcaactcagctcccggacgtaatcttgagaatggtccaattttggcattattgcccacaatggcatcttcaatcacagaataaggttttatttccacattatctgcaatcgtacaatttttcagtacacaacctgccccaataaacacattattgcctaatcgtaccgttccttcgataattacatttatatcaatttccacatctttaccatgagttaattcaccacgcaaatcaaaacgtgcaggatcagcgaaagtaacacctgcaagtaacaatttttctacttgcttacgttgataatgacgttctaaattagctaattgtaaacggttatttactccctctacttccataagatctttagcttgtaccgctacaactttgaagccatcttgattggcaagtcctattacatctgtcatgtaatattcaccttgtgcattattattatctaaacgagctagccatttacggaaacttgcaccgtccgataccataacgcctgtattcacttccgtaatttttagctgctcaggattagcgtctttctgttcaacaattgccgttaccgtaccattttctcgaatcactcgcccataacctgtaggattgtctaaattaacggtcaaaagtgcgataccattttccggtttttgtgaaattaaacactcaagggtttccttgctaattaaaggtacatcaccatataacatcacaatattttcgtcatcttggaaaaaaggcactgcttgttgcattgcatgccctgtacctaattgttcagattggaatacccagtttacaggttcatcagccaaatgttgttttagtagatcagcaccatgtccataaattaaatgaatttgtgccgcacttaattttttggcggtatcaatcacatgtttaaccatcggtttacctgcaattttgtgcaatactttaggtaaatccgaatacatgcgagttcctttaccggcggcaagaataacaacgcttaatttgttcatgataaattttctctttgtcataataatcgatgtattttagcgtaaaacacatgaaaaaataatataatgttattatgtttagcaaacatacgttcttcttttatgcaaaaaaataatcactattatattggaattatgtccggtacaagtttagacggtgttgatatagccttaatggattttaatcaaagaccgcccaagctacttgcaagccattgtttctctatgccggaaaatttacgccaacaactcaccgcacttttaaaaaacggagaaattggcttacagcaattaggcgagttggatcatcaactgggattactttacgcaaactcggtacaacgtttcttagcacaaaatcaaatgaccgctgatagtattcaagccatcggttgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtaccggacgggaattatttaatttggcgtggttgaacaaaaaactgaaaaaacataccgcactttctgcacaagatgtacaggcaacgttgctggaatttacggtacaatgcacggtgcaagagctggttaaactcactaatccgaaccatttgccttgtttgttgttggtttgtggcggtggtgcaaaaaacagacaactaatggctcgtttacaagcctgtttaccgcaatggcacgtagcaacaactacagagcatggtttatcggttgattatgttgaagccgccgcttttgcttggttagcgtatcagcgtataaatcatttaccctctaatttaccaagtgtaaccggtgctaaaagtgcggtcagtcttggcgttatttatccgaaataatcatgaataaacaaaatttaattaatcagttcgctcaactaattaccgagcaacccaatccactctcagtaaatttggatcaaatgtctgcacttgaaattgtacaattgatgaataaagaagatcagcaagttccactcgtcatagcaaaagcacttccggaaattgccgttgtagtggaaaaaatcgttgctgcttttcgtcaaggtggacgcttagtgtatcttggagcggggacaagtgggcgtttaggcgttttagatgcctctgaatgtcccccaacctttggtgttaatcatgaaatggtaaaaggcattattgccggaggagaacaggctatccgttatcctgtggaaggcgctgaggataatcaacaagcggcaatagtagatctgcaagcaatccaattatgttcaaaagatattttagtgggtattgctgcgagcggtcgtacaccttatgtcatcagtggattaaaatatgccaaagagatagggagctttaccgttgcaatcgcaagcaatccacaaagtgctatggcaaaaattgccgatattggcatcgaaactattgtcggacctgagattttaaccggttcaagtcgcctgaaatccggtacggcacaaaaattggtgctgaatatgctaaccactgcgagtatggttttacttgggaaatgttatcaaaaccttatggttgatgtacaagcaagcaatgaaaaactcgttgatcgagcgacaagaattattatgcaagcaaccggttgtgaacgagcgaaagcagagcaaacgctaacacaagcagataataatgcaaaactggctatcttaatgattttaatggatttagataagcaaagtgcggtggatttattagcgaaaaatcaagataaattacgccaaacgttagactgatttttcaccactacttttctactaacaaggctgtcagtacatttgagagatgagagagtttgtaaaaaataggcggagaagataaaataaagtggttcgaaactgtagattaaatctaactagttaatattgttcataaatattaatattcagtttataaacaaacattcggacatgaattgcaagctggatatgtatagtttgcaactgaaatatgatctcaaggaggttaaatgtctttattaaatatcattaaatcgtttttctcatctaaaaaggagcaagccatgccgaatattctcgtcatttcaggtcattcaaatttacagcaatccactgccaacagtgctattttaggtgaattggcaaataaccttccaaatgcagaaattcgtaaattagatgagctttatcccgatttcaatatcaacatcgaagctgaacaagcggcattattaaaagccgatattatcatttggcaatttccggtgaactggtaccatttcccagcgattatgcaaaaatggttatctgatgtgttcacttatggttttgcttatggttctgagcaaaaattaactggtaaaaaattgtatatttcttgtactacagcaagtccggaagaagcctatcaacacgatggtgcacaaaaacacaccattgaagaatttagttatgcttatcagcaaactgccgcactttgtggtttagaattttgcggtattattcattctggcaatatgctttatattccgggtatgaatacagaggaagataaagaaaatgtaattgcaaaagcaaaacaacatgctgaacgtctagtaagtgcggttaaataacacatcatgttaatagacaaaagggacataatgttttatgtcccttccttgagtcaaaataacgataacacttcatcatcacatcttttttaaaatctcaattttttctgtatttttttgaaaatctatatcgtataatgctcagtcggtttaacgataacattaaactatgtaaacattacaaacattattttttctaaataaggggtctcttatgagatacaaattatctttagtacttttatcaatgctgcccgcactttcccatgcgggggggggggggtaatttcaacttttacggcaaagcgggaattgatttaacctctcgatttgaaacgatgaaaataacggaaaatcacgatagtgatagaggttttaaattatcaattccggcaagttcaagacaaaacactttctcacccagtatcttctttgaaacgacttacaatattttaccgcaaacggaaattggtctcggactaggctatatcaaacgaaaaggctttgaccatattgcaatttggcctgtcgagggtagttctttatataacccccaaggacagtttcatctgaaagaaacctatagagtaaatcgttatgcttccctgccaatttattttattttgaaacaaaattatgccttaaatgcaaatacaaaattttatctaaagggcgatttagggtattcaattaataaaattcgtaaaacagtatatactctctatgaggatttatccttgggtagtagcacaggttacaaaaaagacagagattttattagtaataataaatctagaagcggtctttacttaggtttaggtttggggattgaatataaatctttcttagtagatattggatattatcatactcattcaaaaatcacttacaaagagcaaggaagttacgtatcaacaccctataacaacgatgcaatacgcttaacgcttggctttaaattctaaaaaataaaaaattaacggtcataaaataaatgttttatgaccgttaaacatattctttaataatgtaatgctaaaaaaacatcaattattttctttaagtctaaattgttgattacggtgttgcacaaatgagtagatgaaatacaatactgtcgccgcaccgaaacagtaataaccgatccacactgccggcaacacgtcttttgccatgaaaatatacagagaaattgaaataaatgtgatgactaaagaaacagcttttgcataagcccaaggttgaatatccacttgcttagtgtattcttcgttgtatggtgtttccattggcatgatgcgaccgataattagcattactactacattcacaacaaataagatagcgattaagtggaaaaaatggatctcaactttaatcacaaatttacataggatataagctaccataccaaatactaaaccgaatttagccgcaatcgctgggacacgttttgtcagtaaaccaaccaccacaacactcaaaattggggcattaaaaataccttgtaattcttggattaagaagaataaaccatccggtgcattggcaactaatggtgcaacaatcattgccataatcgctaaacctgtaccgacccatttacccacgctaactaatttcatatcgcttgcatgaggattaatttgtgttttatatacattgcgggaaaataaagttaccgatgagtttaacgcactattaaaggtggataaaactgccccaacaacaactgccgcaaagaagccgactaacgcatctggtaaaactaaatgaactaaattaggataagcctgatctggaatatctaatttaccttggtaaatatgataagcaatgataccgggtaaaatgattaataaaggtcccagtagttttaaaaatgcacataaaagaacacctttttgtccctcttttaaacttttcgcacctaacgcacgctgaataatggattggtttgtacaccaaaagaataaattagaaataatcattcctgtgaataatgttgagaaaggaacaacagaattatcgtcaccaatagaattaaatttatcagggtttgtttcgtaaatggtttttaaaccatgccaagcattaccatctcccacataagctaaacctaaaacagccactaaaattccaccgaccaataacccgataccattaatagtatcagatacagcaaccgctttgagtccaccgaaaattgcatagactgatccgagtattccgattccccataccataatccaaattgccgtagtcttatcaatgttgaagacggtagagacatcaaagagactttctaatgcaagtgcacctgtataaagcacgatcggcaacaatgaaataacatagcaaccgaggaacaataaagaggtgattaacaatgttcctttgtcaaaacgtttttctaaaaattccggaatagttgcaatgccaagttttaaatacttaggtaagaagtaaagtgcaaacattgcaattgtaattgccgctaaaacttcccatgccattacgataaaaccttcacgataagccaaaccgtttagacccactaaatgctcggtagaaaggttagttaataacatagatcctgcaataaacgttgctgtcaacgaccgcccggctaaatagtagccttcagagttgctaagatcgtcttttctggtgtaccaccaagcaagcacagcaacaagggctgtaaatcctataaatgagataagagatagcatagaaattccttatatgaatgagtgtttctatcattgttgtaaacaacacatcgataaggtcgaatggcgaccttgtttgaaatatatatttcaaaaattattaaatcaaatattttttttcattttgttacagagatcaaactttttagtgaaaaactatcagaaaataaccaagaaaattttatttttaagacttgtaaacccaatatgacattttggtctatatctcaagaaacaaaaatttaaattaaaaacaccgcactttttacattgcataacaccgttactaacaggtaaactagacaaggttaaactagggatgaatatgaaattactaagtaaatattttgtcagatcaatactgaacacgagcatattttgcatatacctagcaagttcgttttcttttgctgaacatcttgttgatttaaaagttgttggtgtaactggtgtacaaaaaacgactaatgtagacgcttatataaataccattgatgaagaagagcgtgatggatctgaacgttatcaacaattagttcgaaccgcaattgataaagcattacgtgcttatggttattacagtagcacagtgaatttcactttacagccggcgaaatcatctaataaacccgtgcttgttgcaaatgtggacatgggaaggccaagtattattcaacgtgccgatgttactattcttggtgaagcaaaagatgatgaggtttttcaagatttacttcgtcgtactgcccaaaaaggcgaacacgtaagccatcctgtttatgaggactataaaagccggttgcaaaagcaattactcgctcgtgggtattttgatgcaaagtttgaggtttctcgttttgaaatcaaaccatccacttatcaaggttggtggaaaatggttttaaacagtggcaccagatacaaattcggacaattcaattttaagcatagtcaaattcgtgaagattacttacgcaatatgatgccaatcaaaacaggcgataaatatttaattaatgatctctcatcacttactaacgactatacatcatcaaattggtttagatcggttttattagaaccgaaagtcgatgaaaaacgcaaggtggttgatattaatgtattgctttatcctcgcaagaaaaatgcaatagatgtagggattgggtattcgtctgatgtaggcactcgattcaagctcagttggattaagccttggattaataatcgtggacatagtttcaattccaatttatatatatcagccccaaaacaaactcttgaggcgaattataaaattcccttactgaaaaatccgcaaagatattattatgaactgtctggcggttttgaaaaggaaaatactaaagatactcaaactatagcagcaagttttgctgcattacgctactggaatagagtgaccggttggcaacattcttttgggttacgtgtacgttatgactcatttacccaagccaatgtttcagatagaacattatttatttatccaacaatatcggcgaatagaacacgcttaagaggtgagttatttcctacttggggagactcacaacgcatcacggtagattttggaagtaaacgttggaagtctgatgtaaacttctttcgaataaaggcctcaacagtttggatcagaacgtttaaagaaaatcatcgtttcttgacacgtggcgaaataggttggttacacaccaaagatattaataaaataccgcccgcacttcgcttttttgcaggcggggagcgtagtgtgcgtggatacggttacaagaaaatttctccaacatcttctgatggcaaaccaataggtgcaccatatctattaactgttaatactgagtaccaatatcaagtacttgaagattggtggctggcagcctttgctgatacggggttggctgctaataaatttaacgttaaagaactacgttatggtgccggttttggtgtgcgttgggtatcaccggtgggagcaataaaacttgatatagctacaccgattcgagatagagagaagaataaaaatatccaattttatattggattaggttcagaattataaggtcgtaaaaatgacacaaataccaaatgaaaatacaacaacagagcgacaggaaactcgctcggttaagccaaaacgtaaggtattacgctggattttatgcacaataagtgcggtcattttattacttattttatttttagtaaccgcactggctacaaatagcggacaacgcttgctcattcagcttgctgatcatttcatagataatctgcatattgctcaaattgatggtgggttgcaagacggtttacaattaaaacaaattgcttttcacactcaaggtattaaagctgatattgaacaagcaaatataaaactggacttacattgtctattaagtggcaagatttgcttaaaagatctcactttaaatcagcctaaaattcagattgatactgctcaactgccaaagtcggaaactaaaacgtcacaaccaatacaacaaatcaagctacctgttgaagtggacatcaatggtattgagatcaaccagctggatctcacaatagaccaacagcaagttaaattagcaaaatttcggaccgcacttactttaaacaatgagcaaggtttaactttactgcccacagaaattaatggtttaacgatagttcaccgacatctcacagaaaaaacaacgaagaagaaaaagagtgaaaaaactgtaagatcccctgttgattgggaaaaacttacacaacagttaaatcaaccgttattgcctgatatgcccgaaattgagctaccttttgatctacatattcaaggtattcaaggaaaaaattggctatatcaacaaattggtaattcaaatataccgcaaagtgatttacaccaaattgaaatatcaactatttatttacacgcagacagtatagataattctattcaattacaaacgtttcaacttgaaagtaatttaggtcagctacgaggtgaggggacattgcgactcaagcaagaatttccgatagaactacaagttcaagcaacgctcaatgaacttaaacatgatggaaaattgcttttgcctcacagtaacatcaattttacattaagtggaaatcttaaaaaacaaaccgcacttttcctgcaaactcagggaacgcttgagtcgatattacagggtaaaattgagctttattcacaaaaaacaccgtttgacattgaattaaaagtaataaacggacaatatccctttgagaaaaactctacagatccattgaaaattcaggacatgttttttactgcaaaaggagatttgctcaattatcaagccacattacaaggcaagctcattggtatgggaatgcctgaaaccaatgtggatttagtactacaaggcggattgacacaatttaccttacaacaacttcgagttaatgcgttaaatatgaaggcgaatgcaaacgccaatgtgagctggaaagataaacttaagttgaaaagcaatattgatctaaaaggacataatgttcggctaaataatatgcgaattaacaaaattgatttattggctaacattagtttacaagatatagtgcaaggacaagtcgatcttgatattgatggtttcagtttaaataatattaaattgaacagcactaaattacaaattaagggaacggaacaacaacactatttaatccttaaatcaaagggcgagccggcttcagcaaccttaaatttacaagggaaatttgaccgcactttacaacaatggcaaggtattttaagtcaagtgaatattcattctttaattggcaatttgaccaatagtgaaaatattttgttgtcttatgataataaaaagacaattgcacaagtttctgcccattgctggagatcatcggatattcatctctgttttcaacaagagttcattgtaggaaaaaccggagaaattccgtttgattttaaaacaattaatttagcgttagtgaataaattgatctcacaagagattttcaaaggacatttatccggtcaaggaaaattcgcatggtttacggagagttctccttatttgacgctacaacttaaaggcgataatctcaatgtggcaaaaaaattagattatcgtacttttcgtttagctatcccaactttaaatataactacagagttacaaaacaataacttaaccctaaattctaattttaatattcaaaaccgaggagacgttaatatggaattaaaattagctgatttaaccaatcagaaaaggttaagtggtcatttaaaaattagcgatatgaatttaaatatagttaatcagttaatcgctagcagtgagaaagtagatggtcaagtcaatgcaaagttgagttttgcaggtgatttaagtaatcctcttttgaatggtgaatttgctgtgagtcaagttcgagctaagttgaaatcagttccttttggtataacaaatggaaatattatactaagcttttatggtgatcgttcaattctaaaaggaaatattcaaactcacgaaagtcatttaaatattgaaggtcaagcaaattggcgtaagctcgacgattggcaagcaggtttacatattaatgcagataaatttaaggtggatattccttccatagctaaattacaggtatcgccaaatattgaaattcatgcaacacctaaactattagcgttaagtggtaatgttgatattccatgggcaaggatcgaaattgaacgtttacctgacaatatagttgctcccagtaaggatgaagtgattttagatggtccccaaaaaactaaagtagttaaattgatgaaaggagaaattgagacaactacaaagagtggtatacaaattcactctgacttaaaaatcaagctcggcgatcatgtgcgtttagaggcatatggtctgaaaaccgaattaaatggcttgctttcagtaaaacaagaaaaaggcaaccttggcttatttggacaaattaatttacacaatggtcattatgaatcttttggacaagatcttttaattcgtaaagggattattagcttttccggtttaccttctcaacctatgttaaatatagaagcaatacgaaatccgacatcaatggaaaatacgaatatgacagtaggtgcaaaaatagttggtattgccgatagtcctgaaatcactatattttccgagccaagtacctctcaagatcaagcactctcttaccttcttaccggacgatctttagaaaatagcggaaataatggttccggtggctcacttggtgctgcattattaggaatagggttagctaagagtggaaaattagtcggtggtattggtaaagtatttggtattcaaaatttgaacttggatacttctggtgttggcgacagttcaaaagttgtcgtaagcggtaatattacccctacattacagataaaatatggtattggtttattcgatggattggctgaattgaccctacgttatcgcctattacctaaactttatttacaatccgtttccggtataaaccaagcagtcgatctactttatcaatttgaattttaacgatgaataacgaaaatttattacaaaaagtaaccgcacttgtacaacaccgcggtgaagcgaaagaaattgccgctattgatttaggctccaatagctttcatatggtgattgcccgaattattaacggctctattcaagttttatctcgtttaaaacaaaaagtacaattggcggaagggttagatgaaaataatatgttaagccaagccgctatcaccagaggcgtaaactgtcttgctctttttgccgaacgcttacaaggatttgatcctcaaaatatcaatgtagtcggtacttatacattgcgaagtgcggtcaataagatagaatttttacaacaggcggcagaggttttcccctatccgattaacatcattagtggggaaactgaggcaaaaacgatttattccggtgtttctcatacccaacctgagatcggtcggaaattcgtgattgatattggcggcggttcaacggaaatgattattggcgatgattttatccctttaattgccaatagtcgcaatatgggatgtgtcagttttgccaagaaattttttccatgtggcaaaatatcaagggataactttcaacgagctaaaaaaacggcaaaacaatgtattgaagatcttgccaaaccttatcttgacttaaattgggattgtgttttaggttcttccggtaccatcaaaaccgttcatcaagttattagtaccaactataatcaacatgcaattatcacattatcgcacttaaacaagttgataacacaagtattgaaagctcaccatttcaataaattacatatcaatggacttaatgaagatcgtgtagatgtatttgttcccggacttgctattttgaccgcactttttgaaacctttgctatcaaagaaatgcgttattcagacggagcattgcgtgaggggattatttatagcttggaaaaggatttccaagtcaaaaatattcgccaacgtaccgcacttggtattatgcaacaatttaatgtggatctcgcacaagcggagcgaacctatcaaagcaccttattgctcagtgaacaatatcaacgttggcaagctgttgaattaaaaactgaaatgcaagatattctgttatgggcggcaaggttacatgaagtgggggtcgtgattaaccataaaaatttacaaaaacattccgcttacattctacaaaatatggaattgcccggctttgataaagaacagcaacgcttacttactacaataatccatcaccaatttaatcatttcaaaatgcctgacattggaaaatttgcacgctatccgagggctgatgtaatcgcacttgttcgtttattacgtttggctattttactcaataaatctcgccaagcgacatcgaaaacaaataacattaccctaaaaatcgaccgcactctaaaaaaatggtcattatattttgatgcagaatatcttgagcataaccctttagtcaaaaatgaattgatggaagaacaaaaacgcttgtcagaatttaacttagcactggacttttattcttaaaaaacgttatatagtagaacgtgcttgtttcatatcagttattgagtactacgataagatagactaatcaagcaatgaagacgggcagttttaacatgattagcgatgtgtttaagaatgcaagaaacagtgataaaaatttaaaaataatattattttacttggagagattatgcctaaactacgttcagcgaccagtacacaaggtcgtaatatggcaggtgcacgtgctttatggcgggcaacaggaatgaaagaaaatgatttcggtaaaccgattatcgcggttgtcaattcatttactcaatttgtacccggacatgttcacttaaaagatatggggcaactagttgctgctgaaattgaaaaatttggtggggtagcaaaagagtttaataccatcgctgtagatgatggaattgctatggggcatggaggtatgctctattctttaccgagccgagatttaattgccgatagtgttgaatatatggttaacgctcactgtgctgatgcgatggtttgtatttctaactgcgataagatcacaccgggaatgttaatggccgcattgcgtttgaatattccaacagtctttgtttcaggtggcccaatggaagcgggtaaaaccaaattatccgatcaaatcattaaattagacttagtggatgctatgattcaaggtgcaaatccgaatgtttcagatgatgtcagcgaacaaattgagcgttctgcttgtccaacttgtggctcttgttcaggtatgtttaccgccaattcaatgaattgtttaaccgaagcactgggcttgagcttaccgggaaatggctcatgtttggctactcatgccgaccgcaaacaacttttcttagcggcaggaaaacagattgttgaactgtgcaaacgttattatgaacaagatgatacatctgttttacctcgctcaattgccacaaaagaagcctttgataacgctatgagtcttgatatcgctatgggtggttcgaccaataccgttttgcatttattagctgctgcacaggaagcggaagtcaatttcactatggcggatattgatcgcctttctcgggtagtaccgtgcctgagcaaagttgcaccaaatacccaaaagtatcacatggaagatgtgcatcgtgctggcggtattatggcaattttaggtgaattagatcgtgccggcttgttgaatagccaaactcgtacaattttgggtatgagcataggtgaacaaattgcaaaatatgacatcaaactcactcaagataaagccatacataaatttttccgtgcaggaccagcagggattcgcactactcaagctttctcgcaagattgtcgttgggatacggttgatgatgatcgtgaaaatggttgtattcgcagtaaagaatttgcgtacagccaagatggtgggttagctatgttgtcaggcaatattgctttagacggttgtatagtcaaaactgctggagtagatgaaagcattttaaagttcagcggtaaagccattgtatttgaaagtcaagaagatgctgtatcaggcattttggggggtaaagtacaagctggacatgttgtggtgattcggtatgaaggaccaaaaggcggaccgggtatgcaagaaatgctttatccaaccagttatctcaaatctatgggcttaggtaaagcttgtgccttacttacagatggtcgtttctccggtggtacatcgggactgtctatcggacactgctcaccggaggcggcggcaggcggtttaattggtgtagtaaaagatggtgatattattgagattgatattccaaatcgtcgcatcgaattgatggtatccgaagaagaacttgctgagcgtcgagcagagcaagataaacttggctggaaaccagctaatcgccagagagaagtttcctttgctctaaaagtttacggatatttcgcaacatctgcggacaagggtgcagtacgagataaaacgaagatataaaagttaaaagtgcggtgttttttatctaatcgtgccctaaaaccacgtcctttagggggggatataaagcacaaatatgatatacttcttactgctaacagaggtcgctttagactctcaatgacggcataatcagggcaggacgtgcccgtagcgtctgtgaagtgaatcgcattggcggtcagcagcagaaacccaccgagagtagcccattgcttgcaatgggagctggtaggaatctccttgctttagctaggggaggacgtcaaagcagaaatggtagtgaaaatggcactttctgtaatagaaaaagttagtgatgattaataaaaataatcaaaaccaacttttgtctactgtgcttttttagatagcaggataaaatcacacctttttattaactattgaacttcaatactggcactttattttcggtgactgtttcttcttccactataactttctgtaagttttcaatagaagggagatcatacatagtatcaagcaatagggtttcaacaatagatcgcaaacctctggcacctgttttacgagctagtgcttttttcgccattgcaatcaatgcttcttgggtaaattctaattcaatattttctaagctgaataaaacttgatattgcttagttagggcatttttcggctcagttaaaatttttaccaaagcctcctcatccagttcgcttaaaggtgcgataacaggtaaacgaccgataaactccggtattaagccaaatttcattaaatcatcaggttcaacttgcttaaataattcggttaaactgactttctcttcatcaatacgaacatcagcaccaaaaccaatacctttgccactggtattcgttcttttctcaataattttatctaaaccggcaaaagcaccgccacaaataaataaaatcttagaggtgtccacacgcaacatttcttgttgaggatgctttcgtccgccttgtggaggaatagaagctaccgttccttcaactaattttagtaaagcctgctgcacaccttcgcctgatacatcacgagtaatagaaggattttcagacttacgtgtaatcttatcaatttcatcaatatagataataccttgttgagctttctctatatcataatcacaattttgtaataatttttgcaagacattttcaacatcttcaccaacatatcccgcttcagttaaagttgttgcatctgccattgcaaagggaacattgagcatacgagctaacgtttgtgccaataaagtcttgccactgcctgtcgggccgataagcaaaatattacttttgcccaattcaacctcagaagtatttttttcgctacgtaaacgtttataatgattatacaccgccacagctaatacttttttagcataatcttggcctatgacataatcatctaaatgtgcacgaatttcatgtggtgtcggtaatttaggctcttcctcttgaaattcttcatcaatttcttcgatgtcatccgcattagctaacatgtcatgacataattcaatacactcattacaaatataaccggatgtgcctgcaattaatttatctacttctttttgttccttaccacaaaaagagcaatgtaattctttttcttttgtcatttctttacccaatatctaccgtttaattaacacgtcatcaactaaaccgtacaattttgcctgttctgcagacataaaattatcacgatcagtatcttgttcaatttgttcaatagattgtcctgtatgaaatgctaaacgttcatttaacgtctgcttaatttttaaaatttcttgtgcatgaatttgaatatcagaggcttgtcctctaaagccacctaaaggctgatgaatcatcactcttgcatgaggcaatgccgcccttttacctgctgtgccacccgccaataaaaatgctcccattgaacatgcttgtccaatacaaagagttctcacattaggcttaataaattgcatagtatcataaattgccattccggcagtgactgaaccgccgggagagtttatataaatattaatgtcttttgctggatcttccgcttccaaaaagagaagttgagcaacaatcaagtttgccatacgatcttcaacttctccagtcagaaaaatcacccgctcttttaatagacgtgaataaatatcataagatcgttcgcctcttgatgtttgttctacgaccataggaatgacgctcatatatacctcttctaaaaaatctaaataacaaaagtgcggtcattcttacaaaacgaccgcacttaaaactataaaaagctataaattacgcttgagggttcattacttcatcaaacgaagacgctttctcagttacctgtgctttcgttaatacagcatcaacagcttgttgttctaacacgacattgcgaatgttattcattaactctttgtttttactataatattcaatcacttctgctggttgttcataagctgatgcaatatctgcgatcatcgctttaacacgttcttcatcagcctttaactcattagaagagatgacttcagagaataataaaccaacctgaacacggcgtttagcttgttcttcgaataattcacgtggtaattgtgcagcttgttgagcattaccgccaaaacgttgtgctgcttgattacgtaatacttcaatttcttgctcaactgcggcagtaggtacttcaattggattttgctctaacaaaccgtcaattacctgagttttaatacgagaaaccaaagcatttttcaattcacgttgcatattttttgcaatttcattgcgtaaatccgctacattttttgtattagggccaaattttgccacaaattcatctgttaattcaggtaattgcattacttctacttttttcaaagtaatcgaaaatttagcagctttcccttttagattttcagcatgataagtttcagggaaggttacattaatttcaaattgttcacccgctttatgaccaatgataccctcttcaaaaccgggaatcatccgaccttgccccattgccaaaacaaagtctgttgattttccaccctcaaactcttcgccatcaacagagccaacgaaatcgatagtaacacgatcatcagctttagcaacatcttgagtttcaatccaagttgcttgttgtttacgtaaaatgtcaagcatcttatcaatatcggcgtctgaaatttccacaaccggtttttcaaccttgattttatccagtccttgaagctgaacctctggataaacctcaaaagtcgctgtaaattttaattctttaccagcttcaaattgttctactgtaaattctgggcgaccggctaaattcactttattttcaagcatcacattgaaaaaatgtttttgtaataaatcgcctaatacatcttggcgaacagatgcaccaaaacgtttttcaatcatttgtgccggtactttacctttacggaaaccgtcaatacgtgcattttttgctacacgtttcaattcttcacgcacagcttgctcaacagcttcagaaggaacggtgatatttacacgacgctcaagaccttgagttgtttcaatattaaatgacattatgttacctcaaaaagaatttgtactcggcggaaacacgcaccgaacacgttagtaaattaaatttacattaaaagacgaggaattatagcgatacaaaagcaaacagtcgaggaaatgacaaataaaaatctgcatttgaacattttttagcctaatagataaaatttttttgccaagaaatttttccataattttggttctcctgttgagaaatataaaatttctgatgttcgcatatcacaaaaagttatttttacgatccagatcgtaaaaaaagtgcgatggtattttccatattttctttttgcaacaaaattctcagtacatcattaaccgaataatataaacgcacaatatgataattcctcaatctgaagatatgtctcctatagtgatgtcgatcgatggagatacttatgaaataacaccgcacttatggcaaagaaatcagcaacaatcccaaattctgctacgctattttgccattcctttacaggaaaatgaacaaacgttatggttaggcgttgatagtctaaataatattagtgcctgtgaaacatttgcatttttgtatggaaaaattgtagaaccggttttacttaataaccaattacttaaacagttactacaaaacttatcaccacagcaaaataatatgttcgttgaagagcaacctataaatcaatatgtagccgagcatcgtatagaagtaactgaaaagtctgatgaacccgtgattcaacttttagatcacatttttgaaaatgcgttaaagcaacatgtatcagatattcatattgaaccgcaaatgaattgcttgcaaatacgtttcagaatagacggtattttacaatgccaatcgcctcttccgctttcgctgagtaagcgtattctttcacgtttaaagttactggccaaattggatataagcgaaacacggttacctcaagatggacgatttcattttaaaacaacattttctgacatccttgattttcgtttatcaacccttccgacgaatatgggtgaaaaagccgtgttgcgtttacagcaaaataaacctgtacagttgagttttgcggaactcggcatgacagaaaaccagcaaaaatcattcaaacaggcactatctcaaccccaaggactcattttagtgaccggtccaacagggagtggaaaaagtatctcactttacaccgcacttcaatggctgaatgataagcacaaacatattatgacagcggaagatccgatagaaattgaattgaacggtatcattcaatgtcaaataaatccgcagatcgggttagattttagccgactgttaagaacttttcttcgtcaagatcctgacattattatgttgggtgaaattcgggataatgaaagtgcaataatggcattaagagcagcacaaaccggacatcttgttctctcaactttacatacaaatgatgctccgtcggcagtttcacgcttgcttcaattaggggtaaagcaacatgaaattgacaatagtttattattggtcatcgctcaacgcttggtacgaaaaaaatgtccacatacagaaaatgaaaattgcacttgtcatcagaaatatcaagggcgaattggtgtttatcaatttttacaaccgcatctaatagataatcatatttgctaccaaacggattatgctcatttgcgtgaaagtgcaatggaaaaagtgcggttagaaataacagatttagcagaagtggatagagttattggacaaagtagtgaataaaaaacggatcttcatgatccgcttttaacctatttaaactttttcaactttaacttgtttaatcatattatccgccacttctaatacagtaatttttagcccatttatttcacattcagttccttcattaggaatttcttctaaatgttctaaaatcaatccattaaaagtgcgggcatcttcggtatctaaattccaattaaataatttatttaaatcacgtaaattggcagatccttcaataattattgttccgtcagattgctgtgtcacttcttcatcaatagatggggcggttgaagtggtaaattcaccgacaatttcttccaaaatatcttctaacgttacgagtcctttaatatccccatattcgtctacgaccaagccaatacgttctttattgttgcggaaattaagtaattgagtatttaattctgtcccctcagggataaaataagtttcatctactgcacgaatgagcgtttctttactaaattcatttttatccagcattaggcgataagcctcacgaacccgtaatatacccagtacattttcatcaatactgcctttataaagtacaacacgcccgtgagcggcatgattcagctgacgcataatcgctttccaatcatcatcaacatcaataccggctatatcattacgtggcaccataatgtcatcgaccgtaactttctctaagtccaaaatagaaagaagcatttcttggtgtgcagaagggatatattgtcctgattgattcactattgcacgtaattcttctgagttaagagaatgtgcttttacttcattttttaaacgaaaaagtttcattagcccgctaataaatagatttataataaaaactaatggactaaaaattttcaatagtatgctaataatatgacttgaaacaaaagcaactttttcaggataaagtgcggcaatagttttaggaaaaatttctgaaaaaattaacattacaaaggtcaataaacctgtcgcaacggcaacgccaacatcaccatatatacgcatacctataatggttgcaattgctgatgcggaaatattaactaagttattgcaaattaaaattagactgaggaaaacatccgttctcttaagcaatttctctgttttttgtgcccctttatgccctttttctgctaaaaatcgcatacgatagcgattaacggaaagcactcccgtttcagaaccggaaaaataagctgagagaataagtaagataattaatgtaataaataaggtactaagggggatactatccaaaatataatcctttcattcatttccataatgccataatatttttacttatgacaatgagaccaagacattttataactctaaaataacacgactaccgaaataagcgacagtgagcaagatcatacctgaaattgtataaataatcattctttttcctcgccaatataatttccaatgtccaaataaagctataccgaaaacaaaccaagctaaaaacgaaaaaatagctttgggaatattatgagcggagaaaaaatcaattaattgaatgctaccggaaataagtgtcaaagtaagtaatatttgcccgctaaacaaagagcgaaagaaatgtttttcaacggtcattaatggaggaacaaccggtgagaaagttaattttttactttttaagctattatcaatccagcgtaattgaatggcatacaacatagcaataaaacaaacggaatatgcaaataaagataaggcaatatggaataataaacttgtattttgacttaaatgataaacccaaatttcaggtaataatgcttgtaaaattaaattgataatagaaaaacagtaaactataggcaacagaaaccaaagtgtttttactcgagccaaaatggcaacagttgcaatagcagcaatcatggcactcactaacgagcaaatttcaattaacgtgaaattattacctatgaacaaatgaataaataacttatttaacgcaataaaatggctaataattgcgatgagtgcggtgactaaaaaagccattttattcaacttaacttcttgaccgccttgccctaataacattggcatgattaataaaatgctaattaaataaaaaaaagctgaaataaccgcaaaccacataaatttaccttacacaatatataataatggttcttattctaacttatccacttgataaaatcgctataaatttcttgcaaatgatgaaaatttaccgaatttcagtataattaaagcagtagttttttcaagaaaatataggattagaaatgtttgaaaatttatcggatcgcttgtcaaaaaccttgcgtaatattaccggaaaaggtcgtttaactgaagataatattaaagatacattgcgtgaagtcagaatggcgttattagaggctgacgttgccttacctgttgtccgtgaatttattcatcaagtcaaggaacgagcgattggcgaagaagtcaataaaagtcttacgcctggacaagaatttctcaaaattgtccaaaccgaattagaaaaagccatgggggtggcaaacgaaaaactcaatttagccactcaaccaccagctgtgattttaatggcaggtttacaaggtgcaggaaaaacaacctccgtcggtaaattggcgaaattcctaaaagagaactacaaaaagaaaataatggtagtttctgtcgacgtctatcgtccggcagcaattaaacagttggaaacattggctcaatctatcggcgttgatttttatccttccaatgtttcacaaaaacctgttgaaattgcacgtactgcattggctgaggcaaaactaaaattctatgatgtcctaattgttgatactgccggtcgtttgcatgtagatgacacaatgatggaagaaattcaacaaattcataccgcacttaatccaattgagaccctatttactgtcgatgctatgactggtcaagatgcggcaaatacagcaaaagcatttaatgaggcattaccactgacggggatcattttaacgaaagttgacggtgatgctcgtggtggtgcggcactttctattcgtcatattaccggaaaaccaattaaattcttaggtgtcggtgaaaaaaccgaggcacttgaaccgttccatccggatcgtattgcttctcgtattttaggtatgggtgatgttctttctttgattgaagatctacaacgttcagtcgatcaagaaaaagcagaaaaaatggcaaaaaaattcaagaaaggagatagctttactcttgaagattttcgtgaacaacttatcgaaatgaaaaaaatgggcggaatgatgtccatgctggaaaaactaccgggtgcgagaaatctccctgatcatgtaaaaagtcaagttgatgataaaatgttcaataaaatggaggcaattattaattctatgaccttaaaagagcgtgctaatccggatattattaaaggttcacgccgacgccgaattgcattgggatcaggtacacaagtgcaagatgtgaataatctgttgagacagttcaatgaaatgcagcgtatgatgaaaaaaatgcgaaaaggcggtatggcgagaatgatgcgtggcatgcaaggcatgatggggggattaggtggattaggaaatatgtttagacgttaatatccacatatttatagggcgagttggatactcgcctttcttttattcagtttttgttaaatctctaatcttgcgatagaccacgtccaaattcgtactaaaatgaattttatgtatttctttcactgtcttagatttaacaatcgttcttaagggttggaactgcatattgcacatatgcaattcttgtgaaggcaacatatgttggataaaacgggtcaaagcatgaattcctccagcatcaagcacagttactgcatcacattgcaatacaatatgtttgatctctttccctgtatgagtagttttttcatgtaagtcggcaaacaagttatccgctgcggcaaaaaagagcggtccactaatacgaaaaactacggtatcacacagatcctcaggatgtgcaatttcaaaagatcttgtcatttcagcaatagtacgaataaacaatagacttgctaaaagcacgccaacggtaattgcaattaccatgtcaaaaatgacagttaaagttaaacaagtcagcaagactgcaatttcattcaaacctgatcgacggattaattgaacaatttgcccaacgtttgccatattccaagcaaccacaagcaacaacgcagacatagaggcaagcggtaaataagacaatgcttttgcaaaaaataatagagagaataaaactaataaagcatgtatcacactggaaataggtgacaccgcccctgatttcacattagccgcagaacgggcaatagctgctgttgctgtaatccctcctaaaaatggtgcaacgatatttcctaacccttgagccaataattcattattagaatggtgcttagtactagtcatattatccaatatcaccgcacaaagtagagattcaattgcacctaatactgccatagaaaatgccgccggcaataaggcctgcaaggtattgaaatcccaattgatcacttctccatcagcattgggaaaattccaaggcaaaataatttcgggtatgacattcggaataccatatcccgtactaccgtctgataggctataactaaaagaagagcctattgttgccacatcaaagccaaaatgaatcaatgcaatggataataacgtaccgataataacagcgggcagatgaccgggtataggtaaacgaaacttatgccattttgtcagtaaaattagcgttacagttccgactgcagcatcagcccaattaatcgttggaagtgcggtaaaaattgcttgcaatttgccaaggtaatgtaccggcattgtggcgacattcaagccaagaaaatctttaatttgcaatgtcgcaatcacaatcccaattccacaagtaaaaccaagcgttacagagagcggaatatattcaatcaaacgacctagacgaaaaaaagccattaaaattaaaataatccctgacaatagagttgccatgagtaacccgcttaacccaaattgctgcgtcacagggtataaaatcaccacaaatgccgctgtagggccggaaatattaaaacgagagccaccggacagagcaatcactatcccagcaacaatagcggtatataagccgtgctgaggcggtacaccgctggcaatagctaatgccatggacaaaggaatagcaataacaccaacagtaagtcctgcaataatgtcctttataagatgcgacttaccatagccaattttaaagctatcttgtagtgcactaaaaggacgaacggcaagaaaaatatttttagttaaaaaccactttttcaacatataaattccaacagacaagatgatagagagaagtattgtaactgaaatttaagctaataatttgttttagcacaagaaaaataaaaaatacttgactgaattagaagaaatctttatatttgccgccctaacttcaatggtgagatgtccgagtggttgaaggagcacgcctggaaagcgtgtatgtgggaaactgcatcgggggttcgaatccccctctcaccgccagagctcttcttttctctgtttttttctgtcttttttctttcattttttatcattaatccattgaaatataagaattttttgcgttttttctgtgtttttctgtgttttctctgtttttttgttatctgtgtttatgtgcctttttgttactaaatgatccctaatttgtgagcttttactcacaaaattttaattttggattttttagggatcatttgggatcttttgggcttgtttattcaattaaatcatgaggttagatgatggctaaaattaatcaatcttttgtcgataaactgaaaactacggggaaacaagagcagatttctttgggatataagctttttttggttatgtctcctaaggggactaaatcttatcgttatatttttcggcatcctgttactaaggctattaagaagaagaatttgggaaatgctgatgtgatgtctcttgagtccgctttgtctttggctatttcttttaattctttgcttgagcaaggtgtcgatcctgttgagaattttaaggcacaatttaagcctgtggagagggttgtttttactctgtctatggttgttgaggattggcatgttactaaggggatgcgtttgagcaagaaacatttacgcgataggttagcccgttttaagcgttatttgttgcctcactttggggagcgggaggttttggatatttctttgtttgaggctcgtgaggttattaaggctatttttgagcgtgcacctcatatgggggagaaggtggcccgtgatttgcgggagttgggcgatcatgctgttgatatgggggtttggagtgctaatcttttggctcctattaagcgttcttttcctcggcctaaggctgttaataatccttgtattcgtgccgatgagttgcctgaatttttgtgtgtgttggctcgctctcgtttggattttcagactcggcttttgattgaatttcagcttttgactatggtgcgggctaatgaggttgttactgctaggtgggttgatgtggattttgttaatgcggtttggcgtattcccgctgagaatatgaagatgaataaggcccatgatgtgccgttgagctctcaggccgttgctctgttgtttgagttgcgtaagtttaatgctgataagccttttattttccctcatcgctctattgacatcctcccccgcctaaaggcaggggattcctactagctcccacagcaagctgtgggctactctcggtgggtttctactgctgatctctattgagattcacttcatagacgcttcgggtatgtcctaccctgatatttattatgcttggactattgcttgcccacgtgtgaaaacattcattgctcccactacatcggcattttctgtatagccacattctacacattcaaaatgagcttgagtttcacggttttcttttgcaatatgcccacaacaagggcaagttcgactagtattctgtgctggaacagcaactaaaaatccgccaagccattgcgttttatagtctagctgtcgtctaaattcaaaccaagattgatcccgtattgaacggtttaagcctgatttctgtttcacattttttccgtgtgcttccactgtgccttttgccgatttggacatattcgcaacttgcaaatcttcaacgtagatcattgcgtggtttttgctgatttgggttgagattttgtgcaaaaaatcttttcggcagttagcgattttatggtgtaatttgccgattttttctttcagtttttgccagtttttactgaacttcactttgtttttaagttgtttttgcagtttggctaacttacctttgtaggttttaaacgcatttatcggctcaaaaaattcgccattagacagggtcgcaaagcgtgcaatgcccatatcaatgccgatttctccgcctttatgcatcgggatttcgtgttcaaattccgtttgaatactcacaaaaaagcgtccgcacttttggctgacggtgacatttttcacttcgcccacaatttcacgactattacgatagcgaacccaaccgattttcggcagatacaagcggtcgttttcctgttcaattttgcaaccttgcggaaaacgaaaactctcctttataccttttttcttgaattttgggaagtctgcacgctgttgaaagaaatttttgaacgcactttcaaggtcttttaacgactgttgaagcacttgagaatggcattctttgagccaaactaactcttttttccattgcggaagtagattagcgattttggaatagcggaatttatgattattatccagttcgtattgttcattttgccacgctaatgccttattgaacacaaaacgggaacaaccgcaaaactgcttgattttacggatttgttcaccatttgggctgatttcaaacttaaaggctttacggagtaacattgcacaaattagaatacaaagattgttattattctacacttggtctatgaaaaaagaaacagagattagacgtggtcgccacgttgtttttaacttacacgttcatttggttttcgtgactaaatatcgcggggaagtttttactcaagcaattttgaacgacttacacaccatttttgaagctgtttgtgctgattttgaagcaaaattagtagaatttgatggcgaagacgatcacgttcatttacttgttgaatatccaccgaaagtagctatatcaaaccttgtgaacagtttaaaaggcgtttcaagcagaatgattagaaagaaaaactatccgagtattcgcaaaaaattatggggaaatcagctttggtctccgtcttattttgcaggaagttgcggtggtgcacccatatctattattcgccaatacattgagcaacaacaaacacctgattagttaggtttgaaacggctacgccgtttgtgccttatatccacgccctaaaggacgtggttttacagcactgtctgataaaacttaagccatagcaaatacttaaaatgcaaagtccaaaggataatattactaatgcgattgcttgtagtttgcctataatgcctgcatcttctttactcatttttccctctagctttaaatgatgttttgttatatacttaactacactttctaaatctccttattgtgacaggggaacactaagccgagtcgctactcggcttttttatttttctatttccgctaaaacgtcaatttcttgtactgtttcagccgtccagatttctgtttctgtatctaaatccttttcggtttctgtcatctgattgagataaatcggctctctgaatttaagtgtaaagctcagatccgctaattcatcgtctagcaaagttaagtcaaaaggcgttttatactcatcttgcatatatcgttctaaatcgttttctgcaagccataagttaatggctgccataatttgcaacgggttaatttgtttaaaaggcaattcatggaaaaacaattcagcactatattcgaggtagaataagatttcgcctttgtcggtaacgattttcccctcgtctatcatttcgccatcatccatccaagaatagaagttagcttgatagcgtggcggtagttttgccactaaatgatcggttaaatcctgatactttaatctcatattagatctaccgtgcctctgcctttgccttttaattggcggattgcctgcaccgcctccgcttgtagttgcttttgctccgtgacaatgtctcgttgctcatgtatctctcttgcggagagggtcgcaaattcgggtaacaattcttgcttggctcttgcgaatacggctttttcaaataagattttttcaaaatttttgccgttgatggtcggactttgaatatcatcaacgcttttaataccttgcttttggtaacgttggctgacgatgttgagatcaaactcaaccgactgtatggcatacactaaaacgctttcaataagctcaagaggaatttgcaaggggatcgctctttgcttttgaaaatcaccgatatttatcgcaccaaagaagcctgtattttcgatttgtttgtcagcaattggattttctctgccgttaagcatgtttacctcgcatttcttttaccacctcatcaaaagaacagggcggacgatttagcaaggcaataaccgctttgatgtcaatctcaggattattttctgctaacgccgcctgttgtgcggggtctattaaatcgctgacattaatgccttcgtcatttaatccaattattaatgcgtttaaacgcataaaacaacggctaataaggctatttacaccggatttaggatttaggtataggcttttctttaatagctttatagcgcttattagacgcataggatcggatacgctcgccgcatgagctttcccagttgcatttttcagcaactggatagccgcttgtttaaaccatgcggaaactaaaacctcgtttaattgccacgtcgtcgctactttttcgaatgtttgcgaaaaatacggctcaacaggacttcccattgctgttgtatgaatagtccaatcaagcatatgtttcgccataaacgttggaattgtgcttttaaagcgttccggcaatctttgaccattggtaatagctttttctgccaaattgaatgcttgctcaaaatgaccaatatcaagcaaatacacaaggcaatagccaataacatcattttgatctgctctcccatcattaaaatgctgctctacaaaaggcatccatttaggtaaaaattgggtgcgtttgtattcgtttctgtccgcaaaagcagaaaattgacggattttttcaacgtcctgatttaatgcaattaataccgcactttgcgttacacttggcatttctgcacttgcgttagcctgtgcgttaagttgagcttgctctaatttagccagctcttgcattcttgcttgttgctctcttaatcccattttctgccctacggttctttattaaagcctaatcgcttgcctgtgccatgggtttatccggtttcccgataactacattttcagcctcgatagccgtcatcaagccggtatcttccactacataaccttcattgcggtagtagcttgtgataatccccatcttgtcttgattgctttcaaaacgacggcgtacacttgatgattgcgtatagatactgagattgtttaatgtggttactgccgcacctttcgccgggaagttcggcggtataatggctcgcatacctgcaaaagtattcacaaggttatgtgaacctaatgccgcacgttctgtcgcagtcaattttgatgctttgctaatgtatttgctttccacattgactaaatctgcacccaccaagaaaactaaatccgtgcggttttgatggcgtaaatctaagccttgttttaaatcaagggctaattcatcaaggttggcaaattctgcatctgtgccgtaaaggtttattttatggcttgagttacctgtatacacattggcggatttttgctctttaagaagtgcaagccaacctttattcacatcagataaatcactttgtgaagtcgttggtgctacgctcttaccatgccagcccacctgcaacatatccaaggcaacttgcttgttaaagaactcagcataaagtgccggtaatttgtcgccaaaacgggcgaactggtcgaacatatcccagggtactaaaataccgctatccgtgcgtgcaagctcatagcctgtttgcgtatggttaagggttgcaatatggcgttcggttggtttgcgacctgtgatgcctttttcggttgcaccccataatttcaagcctttgagatcggttacttgcaccatattgatttcttttaagaaatcgctggattgctggatatttgagcccaataaggcagctttcggggcttctaagctaaactcttcccctaaacgcacctctgcgaaaggaacgttataatgttgtgcgatagcttggataaatgcgttataaatctgttttctgttcattgtatcctcctagaatcctgaattttcaaggttgaacatattgtccgcattgcctaattccgatggtgtttgggtaacaggctgtaataactgattaaatttcgcttctaatacatcgtatttggttttgagctcattaaattcttgtttgctaacggtttccgcgggttgttccgttggtttatctgctgcttgctctttttcttgttgctgttcggcttgctctgaaaaggcttgtgctactgcaccagctactgcagtagcgattaaagttgaaaattcttgtttgtccatgttgtcaatctctattgctgttgggttgcctgtattggcggtattttcttggttttctttaatttccggctgttcgccactgaatagccaattaaaaaacttgctgaaaaagtgattttttttcttgttcggtgatttcattcatgttgtgcacctcttggggaaaattaatattaaactcaagatgatcactgataatcacatcttttgagccgatacgattaaacattaaggcgtttgtgcctgttgatgcggggctgtcagtaatggctaatccgcttaagtatgcttttcctgtttgtgcaaagttcggtgtgatttcaatgctggtaaaaatcttctgccctgattgatttagctctaataattgtgcgttcggtgcaagtcttgcgtatagcttggttttgccctcttcatcctcggtttttaactctaccacccttccatagttgccaaagttgcgatagtgctcaagccaaattaaagcggtataaacttcgggattgtagctttctgccatgtctttgaggtcttgcgcatcaatatgccgaccatcaacagttgccccagcagtcgcaatacaaacaaaattagtaaaaagttctgttttcatttttagcctctatcatttttttattttgcaagtttttaacaggcttttgtaaaagtgcagtgggttattgcgtggttattggcgaatagccgataaataaccgatgggcacttttcttttctttttttagctggctcaaaatagtgcaaaagaggaataaaaatgccaataagtaagctgcgtaagcggaaaagcaaatatgacgacgaggtcatttatcaagctcgttacttgtatttgaaaaaatacagtccacaagaaattgtcaaagaattaggcttaaattcgccccgtccagtgtattactgggcggagaaatacaactggcgtaacttgatcaatgaacaaggcatagaagagttaattgccttacgtattgttgccctgattgagcgtgaggggaaaacagatcaggagatcaaagaactagaaagcctaatagaaaaagatttgcaatataagcatcaacgggcgaaacaggcacaaaaaactaaagaaaatagtaccgcactttttgctgaagaaacgccgggacgaaaaagcaagaaaaaagcagcggttaaaaacgacatatcacatattaccgatgatatgtttgagccgtttttgtccagtttgtttgattatcagttaagagcaagagaacaaaaagcactgcataaagtgcggatgattttaaaaagccgtcagattggggcgacttattattttgcttttgaggcattagaggatgcgattaaaacaggcgataatcaaatttttctctcagcatccaagaaacaagcggagattttcaagacttacatcactaaaatggctcgccaatattttaatgtcgagctaaaaggcaatccgattattttaagcaacggtgctgaattgcatttcttatctaccaataaaagcacggcacaaggctatcatggtcatgtgtacggcgatgagttcgcatggttgcgtaattttaaagagttttatacggttgcttctgccatggcgacccataaaaaatggcgtgaaacttatttctctacaccctcttctaaactgcatgaaagctatgcattttggtccggggatatgtggaaagagtcggataaaaaacgccgtgatattgtttttccaagccttgaacaaatgtgcaatgggggcgtggtttgtcctgatggtgcttggcgttatgtgataacaatacatgatgcgttaaaagggggtgcgggagttttatttgacttagatcaattaaaacaaaaatattcagccttggcatttaagcagctttttgaatgtcattggattgatgatgaagacagtattttcactattagcaaactgctgaaatgtgcggtcaatattaataaatgggcggattttcagcccgatacgcctcgtccttttggcgatcgtgaggtgtggggcggttatgatcctgcacatagttctgatggtgcgtcttttgtgattgttgcaccaccaattaatgagggcgagaagtttcgggttttggctcgttatcaatggttcggcttgtcgtaccgttggcaagcggagcaaattaagaaactctatcaacaatacaactttagctatattggtattgatgcaaatggcgtaggtcaaggggtttttgagatgatccaagagttcgcacggcgtgaggcaagaccaattttatatagcctggaaacaaaatccgggcttgtacttaaagttcatgaccttgttgagcgtggtttgattgagtggagcgaggaggaaaaagatattgctgcctcgtttttgatgatcaagcagacctccacacaatccggtgcaaaaattacctttaccgcagaccgcacttcacaattacagcatgcggatgttttctgggcgattgctcatgcaattaataaaaaatccttaattgatgatagaccaagacgccgctcagtatggcgtataaattaggaataaaaacatgaaaaaacaaaaaaataccaataagccgataatgttctcttttcagccgcaaggagattgggagctatctatgccacctgcgttagattacacaggcatttattttaatgacttttatcaatgctacgagccgccgatcaaacgttggtcattggcgagattgccttcgcaaaatgcacaacattgcggcattttgcacagtcgggcgaatatgatagccgctgactatgaccaaggtggattgtctaaaatggatatgcgtgcggcttgtttgaatttaattcagtttggtgatgtgggattgttaaaagtacgcaatggctttgggcaagtggttaaattaattacgctctccagtctgtatttacgcaaaacgaaagagggaaactatcgctatttggtgcgtagatcgctcacggatacagaacaatccgatattcttacttatccggcacaagatattatttttattaagctctacgaccctatgcaacaggtttatggtgtgcctgattatatgggcggtattcagtccgctttgttgaattctgatgctacaacgttcagaagacgctattttgctaacggttcgcatttgggctttattctctatactactgaccctaatgtcacggaggaaatggaagaaaatatcaataaatccttaaatggttcgcaaggcgtggggaattttaaatcgatgtttgtgaattcgcctgatggtcatccggacggattaaaggttattcctattggggatacgggtaaaaaagacgagtttggaacaatcaaaaacgtatccgcacaagatgtattaactgcacatcgttatccacccggattatccggcgttatacctcaaacggggagttttggcgacccgttaaaaatgcgtttggcttatcgccaagatgaagttttaccgatgcaagatttaatttcatcgtccattaatggcgatattgagatcgcacgaaataaggcgttacagattagtttcaaacaacgtcaaatactgcaaaaatagtgattttatgctaaaataagcacctgtttgacgaagaagaagggattttcacaacatggcacgaatttttaaaatctattgtcgagaatgtaaatcacctgcgattattcagcgtacagatcgcttgcatcccgatctttatgatttatattgcgtgtgtaaaaatcctgaatgtggccatacttggaaagcacaatataatttttctcattctttgcgtcctacacaattagaccgtgatgaattggtcaaatatttaattagtaagatgcctaaaacagagcttgagcaactgggaagggatatagaacagcagttaaagttggcaatatagccgtaattttaggcagtcaacatcaaggctagtttccttttgccttggtaaaggcggaagatcataacctccgccttttttcttggtgactgggatatgtttaaatggttggtatattttcataaaactttttcggttcacaaccgcataacatcatcatcttagcaatgatattccgttgtttttgttcctcatgaacaggcaatttaaaacgctttaaatcttccgctttaaaattcaatccttgcttatactgtaaaaaaaacttcggaaaatatttttctataatgctgaacaaataaaacgattgaatttgttcctttggggaaattactgcatatctatcttctattttgctttctttacgtaaatataggacctctcctctcgttgctgatatttgaataataattgtccctattggataaattttgtctttgcttggtctaggttctatttctgctacttctgttaaaaatcgcatttttattttcatataaacatcttacttaaaaagtattttttaatggtttcaagttgagaaataattttaagttcatgctcgataaagccggtgaattgttcaacttcttgctcagtaatgaatagcgagccttgcttactggatataagctgttgtatggctttcttctctttcgttcttggtgcaaaaacttgtgctaaaatttgttttacttgctcaaattcggctttatcctctgcactgccatgtgtcatttcaagttctgccaacattgcaacaaaggcttgaccgcttttttcaatatcattggttaaatccagtagctcttgtgcctccttcagtaaatcaatttcaggatcgggctctgatttatccacataacgcggaatatttaaattgaaatcattttgttgtatttctgtgtaattggctaaatgtgcgagcttatcaatattgtgccttaattgataagcggtaagcacttgattgacgtgctcaggtcgcataatgttattggatttcgctttctcaaataaatctgctgcatcgataacataaatatctgagctttgctttttaaaggttaaaatagcggttggaatttttgcactgataaatagattatcgggcaatcctatcacactcgagaaataaccttgctcaatcagtttttgtctgatttttccttctgagttaccacgaaataacaccccgtgaggaagaataaaatgtgccgttccctcctcttttaaatgatgtagcccatgcaaaacaaaggcataatcagctgcatttttaggtgctaagccaaaatattcaaaccgttcatcactcacgggattccattttgcagaataaggcggattacttaccacacaatccacttttaaccctcgccaatctaattttgtgttttcaatatcgctatattgcccgtttctcgtcagtctatattctgcaaaagtttcaccagttaaaacatcacaatgcttaacttctgcggtgatgccacgcacacaaagattaaacaacaagaatgcaattgcctcttttgaatattcttgacaatagaaagtcgcattagggtttaccttccacttcgctattgttaacgccccggtaccggcacaaacatctaatacactatctacttcaggcgttaaccggctcactaattggcaaatagccgatggtgtaaaatcctgttttaatgattttctgtctgcaaaattctcttgaaactcttgcagaaaacaatcttgacttaaatcaggtttttgagataaatatcgcgcaaagacttcatttcgcttttgtttatcaaataacagattaataagatgctctgttatttgataatcccattttaaattgagtaattcggttattttcatttggataattgataaatcaactcttcactaactccaacatttcccacgggaaagatcttttatctaaaacttctccgccttctatttcaattgcgtgctctctgtcaatttggactattgcttgtccttttttgctaaaatattgatcttgattttgtgcgattacgccataaactgcaccgcgccatgtgtctatttttactcttgaccctacggggaaaggcaatgtatatccgttttcggctacccattgttggatcatttcgctttcttttttgtcgatagcaaaagaaaggcttttttcttcaaattcttttgcttgtgcatagctccagccatggaatttgataaattcttctgccataagatcatcgaatcccgcccaatttcttaatagggtttcatataagcctgtttcttcggcgggtatatcttcgcagtggtcgggatattcttcttcaatccatgctttaataaatgcagcaaaggcatcatcttcaagtgttgggcgtgggacttcggggatccatttgttatttactatcatgttgtttctcctgtttagtgggtttcttctaaaattggggtgattttgtaagcacggatttgtcgccccagcatttttttcgggactttgaattgatattcatagcctttttccggcgttgttgggctttgtaatatctttgcattagcgaggatttttagtgccatgttgcgtggatagccttgcgttgcttccttgaatgcttgtgggataacgtaaaaataaccgccttctcctctaaattcatcttctaggattttgatgccatagattttatttggggttttggcgttttgatctgttgggtattcaacaaaggcaccttcattcatggttatccagtccattaaattagcgatgagtttcgtttcttctcggctgttttcgccatattcctctttccagttcaggaaattttttaatatgacttgttgattttcttcgatgctccattgggtaatatggctggcaagatgtaatgcagtttctagcacggcaaaacgatcagtagccactcgttgcacttggccactcatgttgtcggcaagatctgcccattttttgcggatgattttatagctttcttttgcgagctctgcattttttgccaaaaaggcgatccattctcgccctgcggtgccgtaatattctcttacgctttcgtttaagtggtcggcgtggcttttgttgttggtaaagtaatgtaggttttttgcctcttcgagagggatattaattaaccgcactaattgccctgcgtggacttttacgccttgcaaggcgagctgggtttcgaggtctttttcgcccgttgaaagtgcggtcactttccagcggtttatgtctttgtttcccccctcttttttgccttgtagtttgcctgtttcgttgaataggtcgtaggcgatagcttctagatttttagcatcttttgcttgtccgatttcgtccaaagtaattaagccgtcgttgcgtgctgccgcttcgttttttacgcctacggcggttgcactccagcttaatttgattttgtccgggtcgccataaagactattagcgatatttagaatagtggttttcccttttgagctttcggcgtataaatggacgccaaatgagtcacgtcctaaaattgctaataaaggtgcagcaagtgctacggcaacgcctagcatcatggatggattgccttttaggttttgtgctatttctctttgccaatcgtttaatgtgccttttgtgcggtagcctgatgcggatccgctttcgccattaaaatagataggtttactaggctctccgataatttcgccacttggcaataaataggcactatcttgccagcctgttgatgcggtgactttccagaagggagcttgtctgctgagcacatgaaaatgctctacaagatgattagtcagatttttggccgtcatcagtagccctttacgcttaagttgtcgccatcctgcttctgtgccaaagtcagcaaggcttacagcttctatatggctttctttttggctgaaatgtttccatttgaaaagatagtaataatcgccgatgtcgttgcgtccgttgcctacaagggttaatggactgcatatccaactgagcttttcattgatgacggcaccagtgtcccgatctaccttgggaacaacatagaataagccgttgagcttgccttcttctcgttcgtcaacataaggctctttgtgggtttcgatgtcgggttcatatcctacgacttgttcagcaaaggctaagtcttcgctgtccgttctgagcttttcaagatagtcgctcacatcttctaaaggttcgcccaataaatccacaaaaacaacgtcatttgctttgctgttttgtgccaggttaagcaaaagtgcggttttttttatgggggaaaattcccccgcttccattatacgcactttcttatggttttccgggataatgcgtaggcttgaaatttgttcgatttgcttcggccctaaaacaattggcttttcgggaagaaataccccgaatttgtctttaagcgtgccataatgggaaagaatatattttcctttcttacctgcgtagctccatgcgtcctcgcctacgataataaaagcaatatctgttgtattgatggcttgctttttaaaatcctttacatttggggcgtttttgaggttctttttcttgactatcatatctcttcccttgaggttgaatagcgtcccagctgttcattttgggcgatttcacgccagcttttaaggtgcatatccaaggtataacaaaggttatccatggcgataaaatagcggtcgctttttttatgattaaactcggggctgtcggagcttgcaccgatatgttggatttcaaagagataatcaacgtaggcatttaaggttgaaattgtttctttgagctgtgcctccatggcaaaacgtacaacagaagatttagacatataaccccccttttgtattaatgcgagccacaaagacggcttgatgttgggtgagattgagctgttggcgtgcttgttggattgattttgcacgtatggcgatttttaggcggtttttgcctaagaataggataaatttgaatagcattttgatcgtctctttgtttagtaaatgtgaattgctgttccctaaagggtgcagcaaggtttcaactaccgcaaagaaacggctcgccttattcgtgcggataaactccgccttatctcgacgtatagaccttgccacaaattcagataaacagattgagcttagtaggctcaagccattgatgataggaatttgaggtaaaaaaattccgcaagtcttacgggtgcggtagccgttctttgtagtagtgtcgccaatactaaccgcactttgattttttggcaatactgaaaatttgatttttgtcatgtttctgtaccttttcaaactcatttaggctataatccatgacgttctttttagaactccatgatttatttctttcctatgagttaagttaatttacttgtgcccttgccatttggttgagggcttttttgttgggttatttccactaaactgggtgtaatcttggtgctgccccttagggttcttctatcgtttttgctatcggctccaatcgcttactctgtatttcgtcaatatcgtcaatagaacagaataattgcgttagtactatgtctagtattttttcttgagataactgaacctcttgcccctcgtcattaaaagccattacgggctttttctcttttaactgaataattaaatctcttgaggtttctaatgtgttcttaataccctctaaatcgggcttaaatgcgttttcttggtttgcttgataatttgtattactcatcatctaaatctcctttatagcttgaatatgcagctttaagcgtggtgatttcgtttgataggtttcgcatattaatcaccctcttttaacatattttcttttgcgttttgataaacgtcttttttaatttcaaaaccgtaactattacgccccagttctcttgctgctctaagcgttgagccactccccgcaacaggatcgatgacaacatcgccctcgtcggtaaaaatctcaatcagacgctttaatacatcgattggtttttgggttgggtgtaattttgggtatttcttgcggtcgtcccttgtccattccatccagtttttgatcatctttccgttgttgcgaaacttcggcaatttctcgcggtaaagaattaaggcgtattctgttgcaccgacaactttcatgtttgcctttaagacttgtgggcttgaagacttgataaataccaaggggatatgctttttaaagccatacttctccgcatattcaaggaccatttggatttgttggaatgcacagaacacaatcatgcaaggcgcttgattacgctcttttggctctttaacaagcatttttgaacagaaatgcataaattccgcaatgcgaaagttttcatctgtgtcaaaaaaggctttgttggctttgtcgctttcgccgtttttattatcgccgtccttgtaccattccggactacttgcataagcgttattgcctacgttatagggaatatccgcaatgacaagctgggcttttgggatatggtagcgtttatagttttggaaatggtcgttaaaaagttcgcatttttgggtgcgtttgatgtgttccatttacgcctccttatgcattaccgcttaaagtgcggtattgttttgggttaattcgagcgtagcaaattgcattactgaggtttacgcggttgcgggcttgttgctcgttgttggcgaaaatactgaggtgtaggcggtttttgcctagtaaaatgaatttgtagatcatgagtgtaactccgtttgtgtttttaggagttaccgcacgcaaagttctgaggctttgatattggcggcaacgtatcatgagctcagaaactgcgtcaaacggtacacagcaaagggcgaaacctttcccatgatacgctaccattgagattaaacactttgcaccataagcaaagggattaatttgagatgtgcgtagggtacgaataaaaaaagcacggtttaaaggcgtgctactattcgccgtttgtctaacgttcgagttctgaggctcggcacttgtttttttcaagtgcatattcatcttagtttaatccttttgcttaatcaacatggtttattatgaaatattttcatttatttgtaaaattgaatgaattactttaatataaaacaagattcataataatttccttggtatttctccttgtttgccccggttatgcactacgccggggctttttttatttgctgtttttgccatgcgatcaggttttctctatcccaaatgggaatgttgcccattttttgcggtttggggattattccctgttggcaatatttatagagcgttgagcggcttatgttgagaaattgacaaacttctcgggttcgcatgtagcagctgacttgtattacgggctcttgcatagtcctccttgttggttggtttttcctgtcttttctgtttttctgttttctgttcgtggctatgttagccgtttaagtgggcttgggttggcaaatttgccaagatactttttttgattggcgttaggcttggttgtaccagttctcaagggttacatcggaggggattgccatgttgagatttgctagtatatcgccatgttgatttcttaggcgttcgaggtcttgcccgagcttgccattgcgtagggcgttgcgggcttgttgtggggttttgatgttgtagtggagatataatagggttttgatgaaattaatttgatgttgtgcaatacgggggcttggcggtttgccatttgcccctgcgatgcggttagttctgttttttttgttggtatagctcaatgagcattttaagcacttcgggacggcttttgccttgttctttggcgattacatcgaattggtccgccagttcgctattgatgagcatgctaatttggcgtactttgccttcagcttttaggcgttgattgcgttcttttgcggtttgtgctctgagctttttactatgttctgtgtttgaatttgccatggttttctccttgatttttttaagtgggttgtttaagattggagccatcgggggaacatctcacctttccccctttggattgtctaaattagtaagctggagaactcactaccaacaacgctaataagattatgatgattgttaggaatttcatcattcttacttcgtttaatgccccgtaactgaacaagtcggggcgttcttgtttctagcccttgctagatgttttatattgtatatgcttatataataaaagcgagtattttttactctttacagtattttccatgagtcttttttattatattattgcagttgttttagtcggatattgaggggtttatggcttattctgctatgcaagtggcgaatgcgtttattcagaaagcacaagaggggaaagtccctgcacttacgcctatgaagttgcaaaaattgatgttttttgcacaatcttggtatttgaaaaaatatcatgtgcgtcttattgatgatcattttgtgcgttggcaatatggtcctgttattccttctgtgtactatgaattttcgagttttggatcttgtgatattaatcaacctgctactaatccttttgggattattgcacctaatttgactattgctgatgatgcttttattgatgaggtcattgcaacttacggtagctttgatggttggaaattgtcggttatgacgcatcagcctaagacggcttggagtatgggaaagattggctctgttattacgccaatagagatgtttgaagggaaagtataatgcaaacagaattcgcactttcgttgtaaccgctattttgtccagctctttaacgaattatgccaataggcatattaatgaagaatagcctgcgatatgcaggcttttttatttgttggcttatttgttctatctcttctatcacttctagcgggagtttaaaggctttaagtttaatccctcgctttgcatcagattttgcaactcgttcagcgtttgtggttgccatgtttttctcctgtctttgcttgatttttaaaagttgaagttgtatagtttaggaactgcctagcggtggtacccgctaggtcttacgtcatcctaataagccgattggcttattactaataggatgattagaatgatgattaaccgtggattcatcttctatttcctaagttgccccggtttctccaagccggggtttcttgtttctagccccttgctagatgggtttatattatataggcttatataataaaagcaagtatttcttgaaaaaataccgcactttttgggtgcggtttttttctatttgttagcttgtttaaaacattctagtgcttggataataagttggttttgtggtatgcccagttgttggcttatttgttctatctcttctatcacttctagcgggagtttaaaggctttaagtttaatccctcgctttgcatcagattttgcaactcgttcagcgtttgtggttgccatgtttttctccttgatttttttaagtgggttgtttaagattggagctgttagggaggatgcaccctccctaacatttgttatcttaattagtaagcgttatggcttatgcttattaagacaactaggatgatgattttgattagcatatcctagctccatttaatgccccgtaactgaacaagtcggggcgttcttgtttctagccccttgctagatgtccttattatattagataactaatattaatacaagtatttcttgaaaaaacaccgcacttttggggtgcggtttttttctatttgttggcttgtttaaaacattctagtgcttggataataagttggttttgtggtatgcccagttgttggcttaagttttcaatttcttttactactgttttgggtagcttatagcttttcgcttgcatgccgttttttttcatcacttttagcaacaatttcagttcttgacaatttcatctttaactcctattattttgaagtaccggggagccgttactccccagtttatcgtaactattaataagccgggaaacttagtaatagtagaactacgataaggaaaattttcatcaacatagtattttcctacttcaatcgttcagtatactgatttatacgagtcttttttaaaaaaataccgcacttttggggtgcggtttttttgttatttgttgctctctctatacatttcacaaagttttttaattgcttgcggtcttgatagacctagttcttgtgcaatagcatctaattcgtttgcatcttcggtggcaaattgcattgtgatacgtttgacaataccagcctctaggcgttttttattccattcattcgctgtttttattcttaatttgcgtgaatgttctgtttttgcgtatgccatggttttctccttgcttgattttgttagtcggtggttgtatattaggaactgcctagcggtggcacccgctaggtcttacgttatccttagtaagccggcacgcttaccaacatcaggataataaggattaatactttaaccaacataatccagttcctattttagttgagcggtgaaagccgctcttcttatttccgccctattgcgaaaacgtgattagtatattacaataatatactaattgcaagcattatcttttttatttcctttgtttttcttctcttttttcttcttctcttttttcttcttctcttttttctcttcaattcctaaaaaataggaacaaaattcctaaaaaataggaacaaaataggaaaaaataggaacagtcaattttattaacttattgatttttaatgtattcattaaaaaaattcctatttttcctatttttcctaatttaatttcatgtataaatgtttttataataaaaaagcacccctaagggtgcttatttatttacatccacataatggaatgggcattggtcgatgttttgctctgataattgctccagtttttggatcttcacgagtccatctgaaaataatagggcaaacacagccacatttagaacaaatagttgtagccataagactaatctccatttgataagttgccatcacttatctatggacaataccgcacaatctgttttagaatagactaccgtttcttctatgttgtaggtattgtgtacagcggatggagaactgcacatagtaattaatacgccaatattaattacttccagtaaagacccagccatttcagttgggttttttacattccgccaaaatcaagttctaattgcggtgatgtgtaaaatcctaatcgttctaaaactatttctgcaaatgtatcagcttgccattcagcatcttcattctttgtcggtggaacctttgcattatgcaataccgccctatgacctaaaaacaaatgaccaaattcatgaaatataatgaataaagatgttctatcacctctacaagctaactcataaatactttcaggaatagttattgtaaaagtacttggatcaaaatgacctcgcgttaaattccctgttgtttccttccattcttcatctgattttatagacaaattgataataaaattacttctctcctcaatttgctgaaaaaccttctcgcatttcttgcgtgatttttttgtaagtccgaattcgtggcaaaagttcaaggcggtggatataacttcaacttcttgcataggtgggaccctatttcctcgtaattgatatgaactcatttactatccttttcatgattaatacgagttaataattcagaaatttgagctagttctttagcggtataacgtgaattagcgaatccagccactagcatcttgtgatgttcagataaaccatctatcggaacattttcattagaaacatcggctaatttttgtaattctttcacctcgatgcctttctctttaaaaaaatgagttatcgcaacgacccattttttagatatttttttacttcctgtttctaatccgcttaaataagccggtgtagttcctaatgcttttgacattgtgagtaaggtttcattagcatcaattctagccttacgaactattttgccaaattctgtaagagccataatatattctcctagtgtgtagccatgtttgtatcttatttaaaagataccttaaaaagtaataaaattcaacctttttagttaaatttaaattttatttcctgtgccattcctatttttaggataaaaataggaacaaaattcctaaaaaataggaacaaaataggaaaaaataggaaaaaataggaacagtcaattttattaaatgattgatttttaatgtattcattaaaaaaattcctatttttcctatttttcctaatttaatttcatgtataaatgtttttataaatcatgagataagttaacttgttttttgtaatgaaaacattacaatagacatattcataaggagaacttaatgtactcaataaaacagacatcaatttttaagcaatggttgaagaatataaaagatcctattgctaggattatggtgattaagcggattgaaagagcaaaaaatgggaactttggcgatcataagctattggcaaataccggcggaatttatgaaatgcggatagataccggcaaggggtatagaatttattacgcaaaaattgaggatattatctatttgctaacaaacggtggagataaaaaaactcagcaacaggatataagcgatgcccaagtgatattagaaaaatttaaacaattaggagatgatgaaaatgagtgaacaaaacaatatagaagtgactgattttgatgctgcagaatttttagaaaacgatgaattgatcgctttatatcttgcggagacattaaagaatggtaatgatgaagaatttattcaagcactcaatactgtggctagagcaaaaggcatgaatgatattgcgaaaaaagcggggattgctcgtgaaagcctttatcaaactctttcaagcaataagccgagatttgaaactgtgcgtaaaatcttaaatgctttaaatattgatctcattcctacggtaaaaacggcttaaatgccgtttttttctgtgccattcctattttttaggataaaaataggaacaaaattcctaaaaaataggaacaaaataggaaaaaataggaatactcaattttattaactgattgatttttaacatattcattttaaaaattcctatttttcctatttttcctaatttaatttcatatataaatatttttataaataaaatttgtattattgccgttttctatgaaaatttttcacttttttattctgcttatctgatcaaatatttacccataacaaaaaagcagaataccaaatgatccctaaaagatagttttaaaaacaagaacccttattgtataaggcttgaaccctcgaagcagatgaaccctctcaccgccatctaactgtaaaataaagtttgtcttgtaaaaaacaattaaaaaatcaataagttaccattccttaattgttcacattgtaaaataatgtttgtcattgtaatcgcttgatgttcccttttatgttccttttttgagagctaaaaaagtaacagcaacgttatttttatgtagagctaaaatctatgtaaacgtttgcttaatgaaagcgggctgcggtaaaataacccgattttatttaaagctaataaggtattcatatgacacagctaagtttgaaaaaaatttattcggggaaagtacgggatctctatgaaattgatgataaacgcatgttaatggttgcaacggatcgtttgtcggcattcgatgtaattttagatgatcctattgatcgtaaaggtgaaattttgacgcagatttctaatttttggtttaagaaattagcccatattatgccaaatcattttaccggtgaaacagtttacgatgttttacctcaagccgaggcagatttggttaaagatcgtgctgttgtttgcaaacgccttactcccatcaaaattgagagtatcgtacgaggctatttaacgggatcgggattgaaagattataaagccactggcacaatctgcggattaaaattgccggaaggtttggttgaggcaagtaaattacctgagccgatttttacaccttcaagtaaagcaaaagtaggtgatcatgatataaacattagctatgaggaatgtgagcaattaattggcgttgagcttgcaaagcaagtacgggaaaaagcgatttcactttataaagaggcagcggaatatgcactgactaaaggtatcattatttgtgatacgaagtttgaatttggtttagatgaaaatggcgtattaaccttaatggacgaagttttaacgccggattcaagtcgtttctggtctgtggaaacttatcaagaaggcactaatccgccgtctttcgacaaacaattcgtgcgtgattggctggaaaagagtggttggaataaacaggctcctgcacctaaagtccccgctgatgttatccaaaaaactgttgataaatataaagaggtattggatttattaacaaaataattggaagtgcggtgaaaatttgttaaatttgaccgcacttttgccatgaaataagtttgagataatatgagagctgtttcaatcgtagggttagggtggttaggtttaacacttgcccgtcatttaaaaaatttgggttggaaagttaaaggcaccaaacgcacacatgaaggcgtggagcaaatgcgtttaattcgattggaagcctatcatctggaactcacacccgatattaatgctgatcccgatgatctaactgcattactttctgtggatgctttagttatcaatattccaccgagtcaatatttttttcatttacaacactacgtacagggcgttaaaaacttagtgaatgaggcattgttaaacggtcttcaacatattatttttatcagctcaacctctgtatttcctgatgtttcaggcgaatttgatgaacaaagtcagattgtaccccagtcagaaatgagtaaagcattgcttgaaattgagcaatggctgtttgagctgaaagatgttgactgcgatattattcgttttgggggactggtgggcgaggatcgtcatcccgtttattctttagcgggaaaagacgaattatcagcagggaatatgccgatcaatttggtgcatgttgatgattgtgcaagagctattcaattgttattggaaacaccaagttcccagcgtttatatcatttggtcgcaccgcaacatccgactcgagcagaatattactcacagatagcagaaaaattagcactggaagcaccgcactttatttgttcggaacaagatccaagacgtgttattttagcgaataaaatttgccgagagctcagttttgtttatcagtgtccagatccttatttgatgttatttgaaagaaaataaaaaatatccgatttgcatttttaatcaaaaaaatgcaataatatgcataatttattcaaaaaaaaatctataatgcaaaaaagaaggtcataaatgtcaaatacaattttacaacatcttccaattggtcaaaaagtaggcattgctttttccggtggtttggataccagtgcagcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgccgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgctgaaaaagcttactcgacggattccaatatgttaggtgccactcatgaagcaaaagatttagaatatctcaatagcggtattcgtattgttaagcctattatgggtgttgccttttggcgtgatgatgtaactgtgaaagcggaagaagtgacggtcggatttgaagacggtgttcctgtcacattaaacggtcagtctttttcaagtgcggtcgaactctttttagaagccaatcgcatcggcggtcgtcatggtctgggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagcccgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacgcgtgataaattgggtatttatacacataccggattactgactgtaggtaaagattcaatgttaccgcaattggataaaaaatagtttttttacacgccgacatagttgaccgcacttttaagtgcggttagtttttgctacaattctccgttttaaaacaagtaggttatacaaacgacggattcatctgataatgaaaaatttattttcttttccttctttctatcagttttctaatgaaagacgttttttaaaacggttaagaactcgtattcgctattatttttatcgtttaacttgttttaaagaatgtcagatttttgttacctatttaaatcataatcctctttggattgatatattcacgaaaagttactaccgttgtgatgctgtacttagaaagtattgcgataaccgttttaataaaaaacaacgtgtacaagcaattatggataatttttccgtagcagaacaagtatttgggcggtctttctcacaactgttagttgaaaaagataaggttttattggctgaattaacagatgagttggatttgtatttagcaattaatcaaatagatccttttgaggggttttttgcggtaaatattcgcaataaacagggtcaacgtatttacgatgcctctttttcttttttggcagggaataaattattgatcacgtctgtgcaagggcctagtgatgataattcacaagaattaattaaatcgacaacgaagcaattacatggtgtacgcccaatgtttatgttggtaaatgtgtataaattgttagcaaaagagctgaattgtgaacttttaggcatagcacataaaaatcaaggaaaatatcgttggaacgacaatgcacgtttgttatttaattatgatgatttttggcaagaaaataatgcacttttaaaccctcagggctattggcaattacctgtagttattgaacgtaagacgctggaagatattcaaagtaaaaagcgttccatgtatcgcaagcgttatgaaatgtttgattttattgaaaaaaatataactgagatttttggaaaagaaaatttgaataaatagaccgctctatttggtattcaagttttaaatggcatataatgagttgctattgatttttagtttgttttattaatttaaaggtatgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgaccaacctattttgccgggggtattaattttagaagcattagcacaagcgatggggattttggcgttcaaaactcacgagttaagtaataaagagctattttattttgctggtgtggatgaggcacgttttaaacgtcctattttaccgggagatcaaatgatgttaaaagttgaagtcattagggaacgccgtggtattaccgcttttactggtgtggcgagtgtaaatggtgaagtagcttgtgaagccaaattaatgtgtgctcgtagataattaaggagcaaaaatgattcattcgactgcaaaaatccatccttcttctattatcgaagaaggtgcaaaaattggtgaaaatgttgttattggtcctttttgtattgtgggaagcgatgtacaaattggtaaaggtaccacgttacattcccatgttgtcgtgaagggagtaactaccataggggaagataaccaaattttccaatttgccagcattggtgaagtcaatcaagatcttaaatatcaaggtgaaccaacgaaaacgattattggtcatcgtaatcgtattcgtgaaagtgtgactattcatcgtgggacagtgcaaggtggtggtgtaactcgtattggtgatgacaacttgttgatgattaatgctcatattgcacatgattgtcaaattggaaatcgttgtattttagccaataatgcgacgttagcaggacatgttgaattaggtgattttgttattgttggcggtatgtcagccattcatcaatttgttattgttggtgcacatgtaatgctaggtggtggttctatggtaagtcaagatgtgccgccttatgtgatggcacaaggcaatcatgcacggcctttcggagtaaatatagaggggctaaaacgccgtggttttgataagccgacactacatgcaattcgtaatgtgtataaactgatttatcgcagtggcaaaacccttgaggaagtcattcctgaaattgaaaattatgcacaaactgaaagtgcggtgagttttttccttgactttttcactcgatcaacacgtggcatcattcgttaatgggtagcctaaaataatgttgtaataaaataggaatgaaccgcactttttttaagtgcggttattttttatggtgtttttatgatagataaaaaaaatataacaattggcattgtcgcaggcgaagtatccggtgatattctcggtgcaggtcttattcgagcgttaaaaatacaatatccacaggcacgttttattgggattgccggtaaaaacatgttggctgaggggtgtaaaacgttagttgatatggaagacattgctgtcatggggttggtagaagtaatcaagtatttgcctcgtctgctgaaaattcgtcgtttagtcattgatactatgttagcggaaaagcctgatatttttattggcattgatgcaccggattttaatttggatatagagttaaaactcaaaaagcaaggcattaagacgcttcattatgttagcccttccgtttgggcgtggcgacaaaagcgtatttttaaaattgctcaagcaacgaatttggtactagcttttttgccttttgaaaaagcattttatgatcgttttaatgtgccttgtcgctttgtcgggcatactatggcggacatcatcgatttgcaaccggatcgccaagatgcttgcttccaacttaatctggagccaaaacatcgttatgtggctattttagttggaagtcgagaggcagaggttcaatttttaactcccccttttttacaaacggcacaattaatcaagcagcgttttcccgatgttcaatttttagtgcctttggtaaatgaaaaaagacgtaaacagtttgaacaaattaaagcccaaattgcaccgcatttagaggtcatttttctagatgggcaggcacgccaagcgatgattgttgctgaggctagtttacttgcctctggtacagcgtctttagaatgtatgctatgtaaatcgccaatggtagtgggttataaaatgaaaccttttacttactttcttgcaaagcgtttagttaaaacaaaatatatttcgttaccaaatttattagcagatgacatgttagtgcctgaaatgattcaagaggattgtactgctgagaaattagctgaaaaattatctgtttatttggagcaaacggaaagtgggattaaaaatcgtcaacatttaattcaacaatttactcaattacatcaactgattcgatgtgatgctgataaacaggcggcacaagcagttattgatttattaaatgatgaggtataaatgacaaatgtatttatttatccgaatgtggaattcattgcaggcgttgatgaggttggtcgaggacctttagtgggtgccgtagtgacggcggcggttattttagatccgcataatccaattgaagggctaaaagacagtaaaaaattatcggaaaaaaagcgtttgcttttggctgaagaaattaaacaaaaagcgttagcttggagtttgggacgggcagaaccggcagagattgataagttaaatatcttgcatgccactatgttagcaatgcaaagagcggtagaaaatttgaaaattcaaccgcactttgtattggttgacggtaaccgtattcctcaattgccgatgtcggcacaagcggtgataaaaggcgatagtctggttgctgagataagtgcagcatcaattttagcaaaagttgctcgagaccaagaaatgatagaactggatagacgttatcctgagtacgcttttgcacaacataaaggttatccaacaaaattacatttggaaagattagctcaattcggggtattacctgaatatcgtcgtagttttgcaccggtgaaaaaattgttatcaactttattgtcaaaaaatcacgagtacgttttcaaaatacaaaaataaatattatgttagaacctgttattgagtataatgagaactcagttttcaaaaggaaataatatggctacgcttttaaaaattggcttagtttcagtctctgatcgagcatcacaaggtgtctatcaagatcaaggtattcctgaactgcttgaatggttaaaatctgctttatgcgatccattcgaagtggaaagtcgcctaatccccgatgaacaaaccttaattgaaaaaacactttgtgaattagtggatgattgccattgtcatttggttttaactacaggcggtactggtcctgtaaaacgagatgtaacacctgatgcaactttggctgttgccgatcgtgaaatgccaggattcggtgaacaaatgcgtcaagtgagtttgcattttgtgcctactgcgattttatctcgtcaagttggtgttattcgtagaaatagccttattttaaatttacccgggcaacccaaagcaattaaagaaacgctcgaaggtgttaaagatgaacatggtaacgtcattgtgaaggggattttcagtgcagtaccttattgtttgcaactgattgatgggatttatattgatacagatcccaatgtaattgaaagttttagaccgaagtcggcaagacgtactttatagttgaaaagtgcggtagcttttttattttgtttgaggaagatgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttgatgtctgaaagaaattcatcgctaactcaagtgctggttgcttgtgctgcaattatcgttattttaggtggcattaaactcgccagtgagattgttgtgccatttctattatcgttatttattgcgattatttgctcacctgtggtgaattttatgactaaacggaaaatacctcattggcttgcgattactttgctttttgtattaattgtggtgttattttattttttagccagtttaattagtaatactgttcaggagtttactcaatctattcctcaatacaaggtactgttgtcacaacgtttaaatgatttgttagcttttgctcatcattttaatattcctttatttttttctaccgatagtattaatgatgattttgatcctagcattatcatgaaatttgtcagtcgttttttgttgagcttctcgaatgtggtaacaaatatttttgtgttgtttttgatagttgtctttatgcttgctgaagcacctactgtaaagcaaaaatttactaaattaatcgttactgaaaatactgttactcaacaaaattatattgaacgtattctacaaggcgttatcggctatttaggcgtaaaaacgattactagtgtgatgacaggattgtgcatttactttgttttatccgtccttgatattcaatatgctattttatgggctaccttggtcttcttattgaattatattcctaatataggatctatcattgcggcagtccctgttattgtgcaaagttttttattaaatggatttatcacgggtttagttgtcagtattgcatttattttgattaatactgtggttggtaacgttttagaacctaagatgatgggcagaaaattgggactatcgactttaattgtttttctatcacttttattttggggttggttattaggaacagtgggaatgttactttccgttcctctgacaatgggattaaaaattgcattagaggcaaatccaaatacaatcaaatatgctgagttattaggtgatgtaagcgatgtgcaaaatgttaaatgacgaaaatttattttttatcagacagtgccgtaaaaccacgtcctttagggcgtggatataaggcacaaatatgatatacttcttactgctaacagaggtcgctttagactctcaatgacggcataatcagggcaggacgtgcccgtagcgtctgtgaagtgaatcgcattggcggtcagcagcagaaaccctccgagagtagcccattgcttgcaatgggagctggtagaaatctccttgctttagctaggggaggacgtcaattgacgcaatatatctacaaaaggcatctttcttttcagatgccttttatcttataaaaacttctttttgtactttactaagtcttttttatgtagtgcaaatacgcctattccgccatttcttaattctaaccattggaaaggcacctctgggaattgttctattaaatgaaccatactattgccaacttcacaaattagtattccattatcagtaagatagtcagcagaatttgccaaaatttctttagtaatagtcaggccgtcaattccggagcctaaagccatttccggctcatgatgaaattctataggcatatcctgcaaatcttcttcatccacataaggtgggtttgtgataatcaaatcatattgatcgagcggtaaatttttgaataaatctgactgaatagggaatacacgatgggtgaggttatgacgctcgatattgatttcagcaacatttaatgcgtcaatagataaatcaaccgcatcaacttctgcatgggtaaattgttctgcacaagcaatagcaatacagccacttccagtacaaagatctaaaattctgattgggtcttgttggagtaaccctttgaatttattcgtgattaaagcactgattggtgaacgaggaataataacacgttcatctacataaaattctaatccacagaaccatgcactattagttaaataggcgataggtaaacgttgctcaattctagcaataactaattgaatgagtgaatttttctctgaagtcgtgagtgctgaattataaagtttttcgggaaaatctagggggaggtgtaatccggttaaaatgagctgaagactttcatcccaagcattatcataaccatgcccataataaatatctgaacggttaaaaatgctataggtccatctgagaaaatcttgtattgtatgtaggctgttctgaacctgatctgttaaaatgcaatctacaagttcttggttaaactgatttatggtactcatattaattctctcaatcaaataaacggcgtagttataccatagttattcataatgagtaagttaaatttaaaaatagggaaaagtatgttaaatgatgaagatatagaactatttcatcgtgaaattcaaggagcaaaaaagatagaacagaatatttttattgcaccacgtcatcgaaatttaaaaaataaagtggagattcgcaatgttcgagaaaaagaagataccttatttttcttttcagatgaatatgaacctttattaaatgaagatggcacggttaaatatttacgtccacatgaagatcgttatttgttaaagcaattacgccgtggtgatttctcgcctgaactttttttggatttacatggtttgacacgtaaagaggcaaaaattgagctggcaagccttattcatgcctgtgaaaaggaacatgtttattgtgcttgcattatgacgggatatggaacttatacattaaaacaacaaatacctcgttggctagtgcaacatccaagagtaagagcgttacatcaggcacccagagaatggggaggcgacgctgcaattttggtattgttggacgtttagattatttgttagcatcaagtttagatgtacgttgattttgccggaaagccgtataaagtgcgggtaatatttggttaatcagattaagttgttgcaatggaattgcgacttcatttcgattgaactgatcagcatgttcatcactaaattgttttaaagaaaactcaatatttagcaataatttttcaaaattatctcgttctaaagtttcaatatgctcaaggacatgaagtaattttttggcgataggataaaactcccctaaaaacaccgcactttgctgaattttctgcatattttttctatatgcacctaaagcagaaatataactcagtagcgaatagttaattttgaccagttcaaatccttcttgcaaataggcttgatattttttaggttcgctattcatgtttgatagggttgtacttaatgcggttgcatattcatgtgcttgccgtctggcaatacgatattttagcggatcacctttgccgaataatagttggctaatgatatataaaaagtatttagcattagcttttatcgcttgttttatcactttatttagttgtagatatttccaatccggccataaataagaaacagcactccaagcaataaagctgcctattaatgtgtcggttaagcgagataatagagcgttatttaaatcaaatcccatgatattaaagctaattaagacttgtagtgtaataaaaaaagtagagtagctataattattgctacggaaaaagaaaaacaatgtactagtgacgacaactaaacctaattgcaattctaaagttggatgtatgtaaggcaatagagaaccgattaccacgccaagaattgtaccaatgatacgttgttttaatcttaacttagtcgccgaataattgggttggcatacgaaaacagcagtaagtaagatccaataacccaattgcaaattaaatatttctactaaactacagctaacaaaaacaatgatagataggcgtattgcatggcgaaaaagttgtgattcaaaggtaaaatgactacaaattgtacgccacatattttttaaaccaatgatctgctctgtatatatttgcgttccttcagatcgttcatttgtattttccgaatattgatccatatggtgtaattgccaattaactgcctgtaaattgtcgattaatgttttaatggcaagtcgttgtaattgatttaagtgactgttttgataatgtatttcaaacgactgattaatacctaaaatcgcttgttccaaacgaggattgtacgaataggatttattgtattgcagactatgagcaatttcacgacaagattgtgcttgtagctctaataagcgttggatacgaaaaataagatccgtattttttaattgctctgataattgttgataattaaaatgacttgaattaattcgttcatgaatatcttgtgcagcaaaataatatttaatcatttttgtcgtacggcgatgtttatgttgtccacgaatgcgatgaaataatgctgtacgacaagcgttaaaggcagtaattaaattaccgtttttcatggcaagaatgacacgtttattttctaattgttcaatatcatcaggatcaaaaaaaagtgattttgtgtctaaatattctgataaagcaagaaaagcttttgtcatattttcttgtacagggcgattttgaaacattaaatgaacaaaaaccgtgcataaactataaagtaatgtgccacataaaattaaaatagggttgatataccaagaaacatttggtgtataagttaatgttgtataaagagctacaacgagtgtaccgaaagcaatagtgctataactttgccctatagcaccaaccatggtaaataaaaaggtaagagcggtcattaataacaaatattcaattccatgccctaaggtgagttgtacactaagagaggaaatagaaaaagcaattaatgtataaaatacatatttaagtcgtcctgttaatctattatccaaatcaaccagtccgcctgcaataatacctaaaattaatggcatagactgttcggaaatatttagtttccaaatagagaatgtcactatatttactgctaaaaaaacaggaatggagagaatgatttttgtattaatccaaggggtcattttatattttttctaaactttttattattttaaccgctcttttaagtaaccttgatagtccggaatacgaatttcagtttcttgttggaatgcaggagaactaattaaaaaatcagcagtagcaatattcatcgcaacaggaatgttccaaacagttgcaatacgcattaaggctttgacatcaggatcatgaggaactgcattcattggatcccaaaagaatatcagcaagtcaattttcccttctgcaattaagccacccaactgttgatctcctcccataggaccgctaagtaaatttttgatttctaaattcgtttcttgatgaattaaatttccagttgtccccgttgcataaagaatatgaggttgaagtaaagtgcggttagtttgacaccattgtatcaaatcttgtttgcagtgatcgtgtgcaaccaaagcaatttttttgttttttgccaatttgcgataggttgtttgcataatgataatccttaataaaaaagtgagcttaggcccacttttgagttaaaaaccggttataaaactatttttgatttttcgcccaattgatgaaacgagcttgagtttctttatctgcttgttggaaccaaaactgtaattgttgctccgcaatattttcaccttgtacaacaacttttcctttttgtgctttagcaaatccgagagcaacagcaggcattgccgttgcaaagttggaaactgaagcaacagaaccggatgcattatattcagataatgtatcaattaggttagcccctggaaggaaaccttcttgcttcagtatttcttgttttgtcgcaattatttttccgctatttgttttgacgatgacagacggtgaatctttaaaatttttaatatctcgttcattttccagtttaggggctgagataactacgtcttcgtttgtgccttgaaatgtaacaacaataggatctgattcatataaagaacgatctgagccatgacgaacaatttctgaaacacgaacgacgacttggtgagtttgcgattcattgatattaaatgatttagtagattttaatagatctttattagctttttgtccatcaatagctaagaaatctatgtttgatgaactggttactataccggcaaaagctgctgtacttgttaatagcattgcacttgcaagtgctgcaaaagaaaatttcataattgctcctatagcctcaggaaatataatataaacttatccgcttttagaaaaagctaaccctgtatgctattccaaattaaataaaatgggaatagaaaaaactcgattatttgatttttttctatttttgtagtgaataagtaaaaaaagaaagcaaatttacttcttagttttttttcatttagtatattcgagaagaaattttgacgctgtggaaaaccgaatcataaatgttcgaatcacgatagatagccattctcaaataaaccaactatatagtccctgattgatcaacccgctttactttttattcattttcgaatagaccgcctgaagatgcaatttctcattgattcgtacgatttcttcatttctgtagggctacatatgaaaaaaatgtcggtattaatttggctttgcggtttttcatcattattgtcggcggtagaacgaccgctcctccaattaaatcgtattgatgcccaacagcaacaacgccaaaaggaacaaattcaacagcaaagtgaacgacttcgttccgatcccgatgtgagaatggaaatttcttcagaaaaacctaccgcacttccctttaatgaatctccttgctatcccattcaacatctttccattgtagattactcctccgataacaagacaaaacctagccaatttcaatgggcactgaataaagctgttacgcaattaaacctccaattaccgcattgtttcggaactcaaggactagggattttgatgaaacaggtgcaaaataatgtgattgaacgaggctatatcacaaccagagtggttgccggcgaacaaaatttaacgcaaggcgtattttctttaacggttattcccggtcaagttcgccatacgattattgccgatgtaagtagtctcccttggtttagtaaactgacagctaaaaccgcattggcatttaaacagggagatttagttaatatccgtgatattgaacaatccttggaaaatctcaaacgtgtgccaactgcagatgccaatatcgacattcttccggctgataacagttcagcattcggtgaaagcgatattaaaatcacctatcagcagcggtttccattccgatttagcttaaatttagatgattcgggttcaacatctacggggaaatggcaaggctctgccaccctttcgtgggataatcttttttctgccaatgatttattctataccactttcacacatagcttaaaacgtcacagcgataattcggggcgtcgagcaacgagaaactatggcttctattattctgttcctttgggttattgggcactctccgcctcattgtataaaacagattatcatcaagatgtctttggggcgtttgataatacttacctctatgcagggcgtagtgagacaaccaatttgaatcttgcctatcgtctttatcgagatgcggtacgtaaaaccacaatttcaggtggcttttggtctcgccactcgaaaaactacattgatgatgctgaaattgatgttcaacgtcgccgaatggctggttggcaactcaaccttagccatattgaatatattaaggcagtaacactgaagctttctctaggatttaaatggggaacaggtgtaggtcgcaccatagcggcaccggaagaatattggggaaacggtacttctcgtcctaaaattattaccgcctcggtagacattaattatcctttctatatggggaagcaacccttggcatttaatacgacttggtccactcaatggaataaaactcctcttattcaacaagatagattgagcattggtgggcgttatacggtgcgtggatttgacggtgagcttaccttatcgggcgagcgaggttggctatggcgtaatgaactcagttggaatattgcaaataaaggacattgggtttacttagccttagatggcggtagagtgatgggacgtagtgatggaatacgattagggcatcatttaatggggacagttttaggtctgcgtggtagttggacgcatttttattatgatgtatttattggacggccattaagcaagccgagcggttttagaacatcgcataccgtaaccggctttaatatcggcttaaccttttaatttagtgcattaggctcaaacgaggattttcttatgaataaacgtcagtttcgtgtgatttttagcaaaacattgcaacctattgtcgtggtttcagaaccggtaaaaaccgaaggaaaaacaaaaagtgagatgcctcaaatgcaaagtgcggttaattttctacccatttttgccgccttaactccccttgtctttcgtttgttctgtgctttgagttttgtcttttcctcgtctgtatttgcggaaaccttaatcatcaaagccgatcccaacgctcccaaaaatcaacaacctattgtgttgcaaacagcgaacggattaccgcaagtcaatattcaaaccccgaatgataaagggctttctcataataaataccaagattttaatgtagacaaaaaaggggcgattcttaataacagccacaaagacacacaaacacagcaagcaggttgggtacaaagcaatccttatcttgctcgtggcgaagcaaaagtgattctcaacgaggtaacatctacacatccaacccaacttaaaggttatgtggaagtggcaggcagaaaagccgaagtgatcatcgctaatccaaatgggcttcattgtgatgggtgcggtacgattaatgcgacacgctcaacaatgaccacaggcaaaccgcagattattgatggacaagtagaaagcattaacatagaaagaggcaaaataaccatcagtggcaaagggttagataacagtcgtgtcaattataccgatattcttgctcgagaagcggaaatcaatgcaggcgtttgggcggggaaaaagcttaatgtggtaaccggcaaaaacaccatcaaacaggcagatatggaacatggcggaaatgatttacaaattacccatattgacagccaaaatctcagtgaaaacgcaccgcactttgctttagatgtgagtgagcttggcggtatgtatgcggggaaaattcatcttgtcggcacagaacaaggactgggggtgcgtaatgcagggcatattggggcaagtgcggacaatttagtgattgattcacaaggtaaaattgtcaatcaaggaatgatttctgcgaagggaaatctacacgtcagtacgaaaaaagaaattcagaaccaagggcaattactcaccgaagctcagctaagtaccaaaagttctcatttggataaccgtggcggtaagattgaaggaagaaccgcacaaattaatgcgaccgagacagtgaataatgatcgcataggttcaacaggatctttgattcaaaccgctgaaaaacttgatattcacagcaaactcgttacaaacaaaaacacgaaagcgtcacaaagtaagccccctgaacaaggtattattgcaggtgtactgacaataaatggcgatgctcttgccaatcaaaacggggcaatttatggcatgcaaaatgttcaacttaatctttcggtacacttggataatcagcaaggcgaaattctctctcttggtgagttacaaattcaaggcgataaacttaatatgaataatgaacatggggaaatcgcaagcagaagtaatttagctatttatgccaataaattagaatctgaaggagaaattgaaagtagccacaatgcgagtattcacctcaagcaagatttaacgcttaataatgctttcaaagtaggcggtaatttagacttccaaacacagggcaattttatcaacaactcagttcttcgtgtgggagagaaactaagcatacaggctcataatatcaataataacagggagagtgagctatccggtaaaaacacccaaattctcagtaatgaaataattaatcgaggattaattgatggtgaaaaaaccttattaaaaagcaccgcactttctaaccttgggacagggcgaatttatggcaatcatttagccattgcgacaccaaatcttatcaatggcaaagaagacaatgcttcgccaaccatcgcagcacgtgaacgattagatttggcggtcggttcacttatcaatcgtgatcatgcgttaatttttagtgcgggagagatgggcattggcggtcatcttaatgaacagcaccatgctgaggggaaagcttcattcattgataatggcagtgcgactattgaggctttgggaaatgcttatgtgaatacagcacgcctacaaaatcacgacttacacttgcgattgggggaaaatcacaccgatgaacggcgagttgaatatgcaccgaaaaatacatctcgacgctatgtactgatagataaagatggcaatcacgggcgatttgattcaagaaataatagtaggagcgatagaaattcttatttaaggctgaatgacggcacaaccattgcggctaatagttggatgcattgggattataatcgccacactattacgacaacgattgaaaaacgtgatccggctaaaattttgattggcggtgatcttcatttatcaggcaatgatcttgaaaataatgcgtctactctttctgtaggaaaacgcttattactcggtgatgaggtatttataaaaaatgataaaaatgaaacgttacattccacaaccggtacatcgctcaataatattgatattgcaggaacgataaatgttacggacaaaggacattgggatagcttccataaaaagaaacgtcgctatggaataaggggaaggaaacgttgggcggtttatggtaccggaagaggggatttgaatgacattcacccgacgagccatttcttcttcaataaggtggataatactatcggtcagcctgttgacagcaccaacacgcaaattacagctcaagctgaggcgattgtgccaaaccaaatgaatggcgtaattattaacttaccggaacaaagtctatatcagattaaccccgacgcccctaatggttatttagtggaaaccgatccgcactttactaaccgtaaacaatggcttagctccgactatatgcttaacgcattgcgttacaatcacgaaaatgtgcagaaacgattgggagacgggttttatgaacaacgcttgattaatgaacaaattcatcaactcaccggacgacgctttttagataatcaccaaaccgatgatgagcaatacaaagccttaatggatagcggtatttattatgccaaaaaatttaacctgcacctcggtgtcggcttaacagcggagcaaatggcagagttgactgcggatatggtatggtttgtgaataaagaaattacgctaccgagcggcaaaaaactgacggtactcactccacaagtttatcttgttgcacgaaatcttgatgtaacttcacaaggtgctttaatttcagcaagagaaattatgggtaatattaacggaaaacttaccaatacgggaacgattgcggggcgaaatctgaccgcactttctgccaagaatatcaacaaccaagggcttgttttgggggattccgtcaatttacttgcaaagcaaaaattagttaacctcggcggtagaattgaagctcttgattcagtgacattagtcggcaaagaaggtgttgacattgcaagtacaacaactcgcctagcttatcaagatgactttggtaataaatttgaccgcactcatgtagataaccttgccggtattcatgtcaaagataaaaacggtaaattaattgttcacagcccaaaagatgtaactattaaaggtgcagaactcaatagtgcaggcggaatacttgttcaagccaaccatattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcctctgcctctaaagtgaagcatagtggttttcttcaatccacgacagatatcactaaacatgaccaccattatgatttagctcaaggctcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgagttcagggggatttggctttagcattggcgaaaagaaaaccaccacagaaaccaatcaaaccaaatattacgccacaggtagccaagtgggaagcctgaaaggtgataccgcccttattgcaggtaaacactaccaacaaaccggcagtaccctctcttcccttgagggcgatgtgactatcggtgcgaaaaaagtcgatattttggctgcagatgaccgatacgaaagccgttataaacagacgatggaacaaaaaggttttacgattgcggtgaatattccggtggtgcaggcggtacaaaatgcccttgcggtagcgaaacaagccgaacaggtgggcgaaagcaaacacagtcgaattaatgccatggcggcggcgaatacggcgtggagtgcgtatcgagcgggacaagggttaatgcaagcgagtcaaagtctcagccaaatggcgaacggcaatatggcacaaggggcgaatgtcagcgtatctatcacttatggcgaacaaaagaatgtgcagaccacggatatccaaggcaacactgcagcaaacagtgcgataaatgcaggtggaaaagtcaccgttaccgccaccggagcgggcaaggaatcggatattcacgttgtggggtctgatgtatcaggtcaacaaggcaccctcttacaagcagaagatgaaatcaatgttcttgcagccaaacaaacgcaccaagagcggagccaaaataaatccgccggctttaatgcgggtgtggcggtgagttacggctcaaatggtttagcctttggatttaccgtagggggaaattatggcaaaggctatggcaacggcgatgaaaccacctaccgtcatagtcatattggcgataaacacagccaaacccacatcatgagcggtggggatacgacccttcgtggtgcacaagtgcggggcaaaggcgtacaggttcatgcccaaaacctcagcattgaaagtctgcaagatactatgacctataaaggcaaacaaatgaatgtgagcggacaggtaacggtgggctatggcttttccgcctccgccaacttcaatcaatcgaaaatcaacgccgattatgcgagcgtacaagaacaatcggggatatatgcaggagatgaggggtatcaaattaacattgcccaacacactgacctcaaaggcggcttaatcacctccaccgcccaagccgaaaaccaaggtaaaaaccaattcagcacaggcacactttcttattcggatattcaaaatcatgctgattataatgggagtgcggttggtgtaggagtacaagcagatattaacggtggctgggacggtcgtcaggttagagatggctcaccggtaagtcgagtgaatcaaggtatcggctttggttatgacaaagacagccaatccagcctaacaaaaagcggtattaatacgcaaaacctcatcattcgtgacgaacaaggacagttggcgaaaacgggaaaaactatagaaacaacaagaggggaaatcagcacaaacatcactacggattccgcagagcaacatacaggcaaactggcaccaaactttgataaagagcggttacaaaaagagttggatttacagcgagaagttacgcaaaaatttgatcaaactcggcaggaagttaaggctgaactgtatgatatcgttgatgaaaaacgagaaaaggcaacgcaaattcgcaaaatcaatggtggttatgataccgaactttccgctcaattagatcgtgaggcaacggatttagatgaaaaagtgcgttggttagatatgggattaggtcttttacaaggtagtgcgggaaatagcaaaacaatgttaggtgtttttgcgggcactcaagccgatcgtgccgttcgttctgccacagcacctaaagaaatgtggtatcacaagaaagtaattaatgaaaaaaccggcaaagtgaagttagaatcaagacaaatttggtcattgaatgatttaagcagagaagaactggcaagcattcaagacacaaatggcaaagttattactgtgtctaatcccggtattttcaataatcgagaagattcattaagcaacgcagaaaaacaaaatcttaatagtacaaacagcagtggtgtcattgtggttatgaatcctccaacagggaactataaaggctggtggatactgtcttctatggtttctgaactgatgtatgtcggttacgaccaattgaataataaagtgttccaaggctatttacccaaaactaattcagaaaaattgaatcaagatatttatcgagaggttcaaaatatgggaaatggctggtcggttgataccgacaatcatagtcgtggtggtattacagccagtgttgctttaaaggattgggtaaacaataaagagcaaaacggcattgccccaatcagaaaagcacgtttctatggtacagccacaaatgtgcagaatgattatgccgatgtgttacagaaaaacggttatacctatacgagtgcggacggaaaaacttataacagcggagcctactcaatcgtgcatgataaagattttgtggggaacaaatggatacctttcttgctaggaaataatgagacaacaaaaggagattgtgggatattttgttattcgcatagctcgtattttgcggaagttcctgagcagtatcaaagagatgaagatgggaatattaaaatggaaaatgggaaacctgttgaaacagaaaactggaaagattacacaaaaaaatggggaacccctaaaacaggtgctgatggtgatataaatcatgctattccaaaattagtcaatcccaataatccgaatggagaaaaatatgaaacaaatcctttttaaatattttatgctaattacttgtgttttgggattaagtggctgcggttatttgctatcacttggacagttaatgcttgatggtaggtgtgcagattggaattgttctaaacctacgccaagatggagaaaggcagttgatgactgttacagtagaaactttggagttgttaagcaacaattaggatacaaagatcatggagaagttcaggatagcgatattgggcagcatatttcttatcagtgtgttcgacatgacggcagatacgatattcgcaaagataagcagtatgggcatttatttgtgaaatgattatgccggtgcggaactcaatagtgcaggcggaatacttgttcaagccaaccgtattgatattggtacccttaatacaaaaaataaaacggattacagtgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacatgaccaccattatgatttagctcaaggctcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagcaggtagcctaaaagggaacactaccctacttgcccaagagcattatcaccaacaaggcagtaccctctcttcccttgagggcgatgtgactatcggtgcgaaaaaagtcgatattttggctgcagatgacagatacgaaagccattataaacagacgatggaacaaaaaggctttacgattgcggtgaatattccggtggtgcaggcggtgcaaaatacccttgcggtagcgaaacaagccgaacaggtgggcgaaagcaaacacagtcgaattaatgccatggcagcggcgaataccgcatggagtgcgtatcgagcgggacaagggttaatgcaagcgagtcaaagtcttagccaaatggcgagcggtaatatggcacaaggggcgaatgtcagcgtatctatcacttatggcgaacaaaagaatgtgcagaccacggatatccaaggcaacagggcagcaaacagtgcgataaatgcgggtggaaaagtcaccgttatcgccaccggagcaggcaaggaatcggatattcacgttgtgggttcggatgtgtccggtaaacagggtacttttttgcaagcagaagatgacatcaatttacgggcagccaaacaaacccaccaagagcggagccaaaataaatccgccggttttaatgcgggtgtggcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacaagttcaagcccaaaacctcaacattgaaagcctgcaagataccatgacgtataaaggcaaacaaatgaatgtgagcggacaagtgacggtgggctatggcttttccgcctccgccaatttcaatcaatcgaaaatcaacgccgattatgccagcgtacaagaacaatcggggatatatgcagggaatgaggggtatcaaattaacattgcccaacacactgacctcaaaggtggcttaatcacctctactgaacaagccgaaaaacagggtaaaaaccaattcagcacaggcacactctcctactcggatattcaaaatcacgccgattataaaggcagccgtatcgggttaagtggttcaatggcaataaactttgacacgccgttaggcaaatacggacaagcccaaagccaaaaacaagcagtgaatgacaaaggcgaaaaactttacatagatagccaaggcaagcaaaccaccgcaagccgagacagtgcaggtaatgcgaatcaagccaaattggcgaaaggcttagattctttaacggggacgacctctttcggattcggatcagatagagaccatcaaagaagtgaaaccaaatcaggtattaataccacaaatatcgcaattagagacgaacaaggacagcttaaaaagacgactaaaaccgttgaacaaatcgcagcggaagttaaaacgaacatgaccaccgacaatgccgaaagccgttcgggtaagctggaaaaccgttttgacaaagatgagttacaaaaagagttggatttacaaagaacggttagccaagactttagtaaaaatgttcaggctgctaatgccaaaatcaatcaacaccttgatcaactcaaaacacagcgagaaaaaggcgaaataagtcaaagcgactatgacactcgggtgagaagttggcaacgagggcaagtgctactcaacagtgttgcctcaggtttaattgcaccgacacaaagcacaataggcatagtagcagccaccgcatcgccggcattatcgtatgaaattgggcaacactttaaaggattagccaaagcaaaccaactcacaggaaaaactgaacgagaagagttaaccgtggaacaaaaagctgcacatatccttgctcatgcagtattaggagcggcggccgccgcagcaggagataatcatgccctagcaggagcaataagtgcaggtggggcggaagctgctacacctgtgattggtaaatggttatatggaaaagacaaaggaagtgatttaacagctaaagagaaagaaaccgtgacctcgataatcggtttgctgggtgctgcaataggcacaacagtcggcaacagctcaacaaacgcagtacaaggcagcctgaatgcacaaagtgcagtggagaataatagccttcatgttgataaaaatggtgtagttattcgtaatatttctaatgatgactacaatatttatcaatatgattatgcttgttctcctgttgctggaaataattgtcctaatttgaaagattttgatgagttgtataattcccccaaaaaagttgtaggtcaagtaatgtggcaggactcatttaccagtccagaatcaggaaaatcttttggtattatacattttggagaaaatatagaaccatatatctatcaacttaatgataaagcatgggggcaatgggatataactgttgctataaaaagtcttccaggtggagaatacgatataaaaagcaattatcctagtgctggttcatatcatggatttttatttcagggtaaatatatctcattgagagatggtggaaatatcttagcaggtatgaatgctgctgttaatagaaaaacttttgatgagtttcaacaagccagtggagcactacaacaaggtggtaagataggtgttttattaaatgtgtttaccggtaagacttacggatctgctcctatgtatggtgaattaccatatcaatacaataaaagtaaatatggttacgatttaggactagaaaggatatggataaaagacgatatgaaaaatatgattcctaataataaataaaatatcggagatatacttaatggaattcgttaataattttaacattttgtcacttttattactaatatttattccgatatttcttacaatatacgttatataccatgccattcattatcataaaacatatatattaaaaatgagctttgtattattgggattaatatttttcagtatgtattacatacattgccgttatattgatccacaaaaaatagctcattattgcatagatggaaaatgtatttctattgttcatctatgcaaaggttgcggtataaactctcctacatatgcgaaaatctatgacggaaagatattatttagatttcaaacaaaaactagaaatcacgccgaattccttatggaagatgatatattaattagtaaaataatattggggaataaatttatcatttatgggtcattacctttaatgtacggtaatgtagatactattaaagtaaaagaagcagctggttatataaatgaagaaagaattgactatattgcttcaagaaaattaaaatttagatatttatattaatttgatgatgtacaacattaaacaatgtaattttttaatgctccaatctgtttggaaatataatatccatcaaatttagaaatatatttgatgaaataattaatcctctattcattgagatataaaatgatatattattaaaataattatgcgacaagatactatgacgtataaaggcaaacaaatgaatgtgaaaggacaggtaacggtgggctatggcttttccgcctccgctgatttcaatcaatcgaaaatcaacgccgattatgccagcgtacaagaacaatcggggatttatgcaggagatgaggggtatcaaattaacattgcccaacacactgacctcaaaggcggcttaatcacctccaccgcccaagccgaaaaacaaggtaaaaaccaattcagcacaggcacactttcttattcggatattcaaaactatagccaccattcagcgagaggatttggcttaagcggcggtgtaacggtaagtggtggtgaggctccaaaagaaattggcggaatgaacctccaacacattggacaaaatgctcaagacggttcatcaaaagtggaatacagtggtattgcaggggtgagtagccaaggtaattggggaataacaaaaggcattacaaccgcacttttaggtcaagtgaaatataaaggtagcgaaagcggtatcacaaccggctcaatcaataccgctcatatcaccattcgccatcgtgatgctcaacaaaaactgaccggaaaaacagtggaggaaagtttacaaaaccttcctaaaatcaatcttcatcaaggtgttgaaaaagctgatgttgagactattcgctcagatttagcacgtgatttaaatacagcaacagagtttgtgaataacttaaataatcaaggtgatgaaattcattataagatggaaaaaaatgaagactctcttttttctatccaaaaaacaagatcagactgtgatcatatttcttgcttggattttgataaagacaactctcaggagctaaaacgtattatttatagtgaagaattgctgacagaggaacaagcaaaattattcagtaaagtcgcaacggcaggcatgttgaatttgactagagaagcgaaagtttcaagtgccgttttatatgataaggacttgtcctcaattgaagatactgcattgattttaaatagaggaagtgcgggtattttaaatgaaattatatttaccggttttgaacgtttcagagcgtgggtaaatatgccggcgatctttggagcatcaaatgcgacgagagctcatgctcagattgcgaaaaaactggatgaatataatgcttacgcagaatctcgtggaacaaaaacatatacatttaaaaattcagcacatagtttaggcgtttcgggcaataaaaatatgttgaattggtcggagcatattggtcagaaatatgaacatactgatgtagaatatttacatttaggcggttcatatccgtcaagtgaaatagatcaacaatcgaggagattatttaagagcgtcaaaacacagtatcatggcgtaaagggtgattttgtctatgagggaacaccagttttaagaaatttagggttgggaatgattgggaataatcctaatgcaacacctaataaagcaaatgtttcttttttagatacacatactaaagccaatcagaatattaataatttaaagtttgtttataaatcagaagaaaatggaacgaaaactaaagaatggttaacaatagaggatatgttaaaaaagacatatactgaaggaattagaaaatttaatgaaattaatgggggtagataatatgaaaaaatttgtttttttagtgttttttttgttgtcaggttgttctgctattatctctttatatcctgggtatgataaggatgttatgcatggtgaaagattctgggtaaaaaaaggaactaatgaacaagtcagtgaaaaaacgtatgtagcttgttttcataaaggcttacaatttgatttaaaccaaaaaggttttacatcatattcacctgattgggatgagtataatgttgctttatatcaaagtaaatgtttgcatgatttaggatatgcttttaaagaggatatattttcaaaatattgttaccattaccaaaatgaacttaactgtaaggcatatcggaaatttaaatattagtttttttgcaatttaatattattttaattcttacttttttctatatcagtataaaacggtagaatgcaatcatatttcttgaatatcagcggacagatgacggtgggctatggcttttccgcctccgccaatttcaatcaatcgaaaatcaacgccgattatgccagcgtacaagaacaatcggggatttatgcaggagatgaggggtatcaaattaacattgcccaacacactgaccttaaaggcggcttaatcacctcgacagaaaacgcagagacggaaaaccgcaaccaattcagcacaggcacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaggcaaaccaccacaagccgagacagtgcaggtaatgcaaaccaagccaaattggcgaaaggtttagattctttaacggggacgacctctttcggattcggctatgacaaagaaagccaatctagcgtaacaaaaagtgggattaatacgcaaaacctcatcattcgtgacgaacaaggacaggttgaaaaaacgggtaaaaccgttgagcaagtgaaagcggaagttaaaacgaacataaccaccgacaatgccgaaagccgttcgggtaagttggaaaataaatttgataaggaaaaagtcttaaaagaacttaatattcaggtaaaagtaacacaggagttcaggaagaatgcattttcgacgatagatgcttatgtactgccaaaacaggctgaattaagggaaaaaataaaagcagcacaaactgaagaggaaaaagatgaactgtataaggaaatttataaattgcaatatcaaaaacgcttgttagaaacgacagtaggtattattgccggtacacctgagattgctattacacaaggaacgctacaacttgcagcgaccaaaatgcgagaagaaacgctaaaaaattcccgcttatttaaaggaattaaggataaaaagacgggacaaatattgagaaatgacagttacagtagtggttattttgatggcgtgaagttaggtggtgtacgaattgatgttgatgtgatttgtaatagcggaatgggggcttgttctaaaaataatgatggttctataacttttaatggaaccaatgattacacacttaaagatgcaatagatcctacacaaaataataaagcaaaaaaattatatggtgaaacaggtggtttccaagcggtagaggggggatggtattttaatggagaacctatttttaaatataaacttggcagtatttcagatttatctgttgaatcttttgcgggtacacacgatatgtcaggcagtcaaatttggggttggtatgacaaattagggaatacagcccctaaaacaccaatgcaagatacgtcatctaaagcaacaactataattgctattcctatatctgcaccttttgccgtagcagatctcatgtctgctgatttttttgaagttttaatgaaaatcggaggtcaataaaatgaaaaaagctgtcttaatatttattttattcctgttggctggttgctcctatcatgatgggtgcttttattctccacaactggttagctgtgttgataaaggggaagtatttccatccatatctcgctatcagaaaccgtatagtttaggaagaactgatagtaatcaacgttggaaagatgtaatttcttgtggtggtaaatatttggattatgatcaaagaagtgttcctttcgagaaacaagaagaattttattattgtatgctgggtaaaggatatatccatctttcccctgcaaaatgtggttatcaaaaccctaaatgggataaaggggtatgtaatttctaatttaaaatgtagatatattacctctgtcaaagatgaaaaagatttaattatgaataaagagagaactatttatgatttaaatagaaataaaagcagcaaataaaggagaaatagcaatgaaagtatttagtattattagtgttgtctttttgattgggtgctcattcggtggattcaaaccacctaagctacattacaagtggcgttttgaagataaaaattttgaaacatcttatgaatatgctgtttttagaggcaaagaaatgcgatcttgtggaatggatcctgtattaggtgaaagtgttaaacttaaagtcaatttgtgtatggaaaaaaaaggatggtatctagaacaaggtccggtgtgtgaagaaaaatatgtatggaatgagccggaatgcattaaatggcgggctaaacacagtaaacctgacgcgaagccatgggaatagtaatttacaacagactgaaaggcaattatgttcacctatatcaagaagaataagaaagtattgggtgaaatcactgcgtatagaagatatttttaggaccaaccaaattttacatcaagaatcaagtaaaaatttgattttaaatggtgcccgagggcggacttgaaccgccacagctcgaaagccgagggattttaaatcccttgtgtctaccgatttcaccactcgggcaggtgtcccgactcggttatgtgatggaggcgtgtcccggagtcgaaccgagctacatggatttgcaatccagtgcataaccgctttgctaacacgccgtagcgtaaattggagcgggaaacgaggctcgaactcgcgaccccaaccttggcaaggttgtgctctaccaactgagctattcccgctttttcgctgcaacacattcgctgtcagtggtgtgcattctacttcgttatgaaaaactgtcaacaattcttttaaaaaaatatgttaattgatgaaaaaagactcaaaacaggtatttaagaatacaatttatacagaatgtgtttgtttctagtacatcactatcacttatttcatttatctattttaatgatatagaaaatattctttaatcactggaaactttgtgcaacaatgcaatcctattatgtcgtacaataataaaatatagctaaaagtgcggtcgtttttcttagattaattaggtgaagttatgacacaacaatatgctctagatacattactggctcaggcaggtaatagaacagatgaaagaaccggtgcggtatctacgccgatttttctttccactgcttatgctcatcatggaattggtgaaagtacgggatttgattatacccgcactaaaaatccaacgagaacggtattagaagaaacaattgcaaaattagaaggtggagatcgtggatttgcctgttcttcaggaatggcggctattcaattattgatgaacttatttgcgtcacctgatgaatggattgtttccagcgatgtttatggcggaacttatcgcctattggattttgcacataagaatattcatggtgtcaaacctgtttatgtcaatacagcttcaagtgaagaaattgaaaaggcaatcactgagaatacaaaggcgatttttgttgaaacaccatcgaatccgttaatggaagaatgtgatgtggcagaaattgcgaaaatagctaaaaaatacaatttgctattgattgtagacaatacttttttaactcctgttttatttagaccaatggaacatggtgcagatattgttattcatagtggaacaaaatatattgctggtcataatgacacattagtagggttaattgttgccaaagggcaagagatctgtgaccgcttatattatattcaaaatggtgcaggtcccgtattatcaccttttgattcttggttgaccattcgaggcatgaagacacttgcattgcgaatggaacgtcatcagaaaaatgcacaggaattggcaaactttttaagagaacagccacaagtaaaagatgtgttatatccaaataaaggagggatgctatcttttcgtcttcaaaatgaaaattgggtaaatccttttcttaaagcaatgaagttaattacttttgctgagagtttaggcggtacggaaagtttcattacgtatccggcgacacaaacgcatatggatattcctgaggttgaacgtgttgctcgaggtgtatgcaatcgtttactacggttttctgtaggattggagaatgtagaagatattaaagcggatttattgcaggcattttctcaactaaagtaaccgcactttaatagatcaagatttaataaaagtcgcaacttatcatacgtaagtaatttgtcgtggtttatgttgtgatttttcacttgaaaagcggagatttatctttatactctctaactggaaataataaatcccaaacaataaaaggaagaaaaataaaaatgagtgaagtattacatacaacagatgcgacttttgatactgatgtattaaaatcagatattccagtattattagatttttgggctccttggtgtggtccttgccgtatgattggacctattctagaggaactttcagctgaattaggtgataaggtaaaaattgttaaaattaatattgatgaaaatcaagcgacaccggctcaatttggtgtgcgtagcattccaacattaatattcttcaaagaaggtaaggctgtcgcaactcaggttggtgcattaccaaaaaatcaattagtaaattttatcaaccaaaatagctaatatgtagcttaaacaagacgaactaaaatagcttaaatctcaaaaggatttaagctattttgtctattacacctttaaatcgtatgtaaaatcataaaacattacctttggtaacggttaaagatttaatatttctttcacaaaaggaatagtcaacttacgttgtgcttgtaatgaggctttatctaataaagttaatgtatcaaataaagatttaatatcacgatctaaacgttttaataaaaaattagctgtatcatcaggtaattcgatccctcgttgatgggcattgcgttttatcacttctactttttgttgttcatttagtggatttagctgataaatttctccccaacttaatcgtgaggcaagatcgggtaaagagatatttaaattcactggagattgattggcacttattaacagtaatgtactcccgctctcttttattctattcattaaatcaaaaatagccaattcccattcatgatttcctattattgcatggaaatcatctaaacaaaccaactcttgctgttctaaattttccaaaacttcaggggaaaaatattgtgctttactcaatggaatataaatcgcattgcgttgcgatgctaaaaaataattggaacatgctttaagtaaatgagttttacctgtactttttcctccaaaaatgtaaaagaaaggttgatataattgaataaaatttttacgtaatgaaccgagtaacaataaattattgtcgctacaaaaattctctaaggtatcatcgtctatctgatgaataggcaaagggagttgttggctcaaaaaataattccatttgatagtaaagttgactcataatacagaaaaaataggaacaggtgaacctattcctattaatcttgtaaattttagtcttctatttgatttttagccgatggtaaaatgagatttagaataatagcgacaacggcacataaactaatccctttcaaggataattctcctaaattgacaaacattccaccaattccaaaagtcataaccacagaaataatacataaattacgtgcttccgtcacatcaactttcccacgaattaatgtactcatcccaacgacggcaatagagccaaaaaccagcatcataattccgcccataacgaaggtggggatcgtagataggaatgctccaactttgccgcaaaatgaaattgcaattgcccatactgctgcccaagtcataatggtcggattaaaatttcgggttagcattactgcacctgttacttctgcataagtggtatttggtgggccacctaatagtgatgcggcagatgttgcaagaccatcacctaataaagtgcggtgtaaccccggattttttaagaaatctttgccggttacagaactgatagccatgataccgccaacatgttcaactgccggtgcaatcgctattggtagcaaatataagatggcttccagtttaaattctggtgtcgttaaattcggtaaggaaaaccaagatgctttggcaataggactaaaatcgattaatcccataaataaactcaagatataacccaccgcaatgccaaacattatcggtattaatttcatcatacctttggcaaaaacagctacaattaaagtagtcaatagcgtaatcattgacacgagaaccgcatcaccatattcatagttactgcctttgccggtcgccatatctacagccacaggtgccagtcctaatccgataatgataataacgggtccaacaacaaccggaggaaaaattttctgtaaagcccccgctccacgtaatttaaccaacaggcttaaggcaacataaacaagtcctgcacaagcaagaccacccattgttgccggaattccccatgaggctacaccatattggattggtgcaataaaagcaaaagaagaggctaaaaagatcggcactttcttgccggtacatagttggaaaagcaatgtaccaattccggcggttaataaggcagtatttgcgtccaatcctgtgattaatggaactaataccaatgcaccgaatgcaacgaataacatttgcaagccaataaaagcttgtttgattttgcccgaaatttctacggggatattttgatttgtcatttaagtttcaactctctgtctgaattaactaaaagtgcggtctattttccaatagattacgcggaaaaaagcggcattaattgccgcttggtattttggtcttatttcgtaccaaaaatcttatcacctgcatcacccaaccctgggataatgtagccatgctcatttaaatggctatcaattgatgcagtatataattcaacatcaggatgtacagcctctaaagctttgatcccttcaggtgcagcaactaagactaggactttaatatgctgacaaccttttgcttttaataaattaatagtcgcaatcatagaacccccagtggctaacataggatcaacaacaattgctaagcgttcatctaaatcacttgctaatttttgaaaataaggaactggttctagagtttcttcatcacgatacatacccactacactgatgcgggcacttggaacatgttccaatacgccgtccatcatacctaatccggcacgaagaataggaacgacagtgacttttttacccttaattcgatcaatttcaacagcaccacaccaaccatcaattatcactttttcagtttctaaatctgatgtggcttcataagtcaacaggcttcccacttcagtggctaattcacggaaatcttttgtagtaatatctgcaactcgcatcaaacctagtttatgttttactagtggatgtttaacttcaacaattttcatcgcatgcttccttattgatcgattatgtaaaaaaaatccaaacggcggaattctaaatgatcttgattaaaattaatagtattgaaagaatgttttaataaaaaactgcaatatgcagatgcagaatatttattttaccttaggcaaactgttgcatgcctagcgtgccgtcatcaataatttcagactctatgcctaagatttctgctactttatcaccttctttaaacatcacaaaaccgccagattccattttattccaatgttcatctttggtaagtgggaacgttgtaataattgttactttatctgtttcttttgcatagtcacgaaaatcaataatattatcatcgtctatgcgttgtgcttttccgaaaggtgccttacgagtgagatagtgtaaatttgttgaacagtgggccatcatccactcaccattagataggataaaattaaatgtgcctctccgtgttaattcttgtgtgagtttttgaattgcactaaacatatcttgttcattaggctttttgggaaaacgtttctttagttggctaagcatataacaaaatgctgtttcggaatccgtcgagcctatcggttgaaaaagactttctgtcatatcgggtaatgaatttaagttgccattatgagcaaaaacccaattttctccccaaagttcacgaataaaagggtgagtattttcaatattgacttctccttgtgttgctttacgaatatgtgcaacaacatttaaagattttatgttgtattgtttaatacaatcagcaatgggagaagaatgtccgggacgattgtcgcgaaaaacacgaattccttttccttcaaaaaaggcaattccgaaaccatcggaatggcaattagttaatcctgctcttcgacgaaatccctcaaatgaaaaaacaatatctgttggggtattacaattcattcctaaaagttgacacataatttatttcatttaacccaattttatgtctttttatctacacaatgagtatgaatttaacaaaaatacagattaaaaatcaacatggatcttagatcaattagttacataaaatagctaaaaaaacttaccgcaccaagttttcacaaggtgcggtaagcaaataagaaggtttaatataaaatgataaggattagtaaacaccttgtgctaacattgcatcagctactttaacaaagcctgcaacgtttgcacctacaacatagttaatatttttttgcccttcgacagtaccgtattttttacaatttgcatgaatatccaacataatacggtgtaatttttcgtcaacttcctcagctgtccagtataaacgttgtgagctttgtgccatttccaaaccggaagttgcaacgccaccggcatttgccgccttaccaggtccaaataaaacgcctgcttccaagaatgcgtcggtagcttcaattgttgttggcatattggcaccttctgcaacaagttgaaccccgttggcgatcaattgttgtgcatcggataattccaattcattttgggttgcacaaggtagtgcaatatccgctttcactccccaaggacgagctccctccacgtattgcaaaccaaattgttcagcgtaatctttaacacgaccacgttttacatttttaatatctaaaagtgcggtcaatttttcttgtgtaaagccttcaggatcataaacatagccggagctatcagaacaagtgacaacttttgcccctaactgcaaggctttttcgatagcatattgagcaacgttacctgaaccggaaactacaactgttttccctgcgaaagattgtcctttttcagcaagcatagcttgagcaaaataaactaaaccataacctgttgcttccggacgaattaaactgccaccaaatgacaaacctcgaccggtaaacacgcaagctgcttggttagataattttttcatatatcctgcaagataacctacttctcgtccacctacaccgatatcacctgccggtacatcggtatctgcaccgacatgacgatataattcagacattaatgcttgacaaaaacgcatgacttccgcatctgacttacccttaggatcaaaatcggaaccacctttacctccccccatcggtaaggtagttaaagcatttttgaaaatttgttcaaagcctaaaaattttaaaatagataaatttacagatggatgaaaacgcattccacctttaaacggtccaatcgcactattgaattgaactcggaatgctcggtttacttgcacttgacctttatcatctgtccaagcgacacgaaattgaaatgcacgttccggctcaactaaacgctccaataaagcttcagagcgatattttggatttttctctaaaaatggccaaatggaagtgaatacttcacgtactgcttgcaaaaattctggttgatgaccgtcacgttgttctacttttgctaaaaaatcttctaacgatacgattgctgacataatttgtttccttcttaattgaaatgttttgtttgcttatttatatagagagcctttatcagcccacgattaatatgcaataaaatatcaaaacattgcaactaaaattattaaaaaaaattaaaaaactatttaaatattaaattttatttaaaataattgtatatattttaaatttattttgattttggttgggttgatagaagtaatatcaaaaagcaggaggaaaaaactaccgcacttatatattctaaattgaagaatttacagcaaaataaaaactggagactatgtttatctttatatgttaagtaaaaaatgtaaatattagtttcattttgaagaaatttattacacactatatgggcaaattattttgcagctatttttactttaggagttattatgaaaaaagcactattaacagcattagtattaggcacgagtttaactgttactggttgttttgataaagacaacaacgtttctcagcaagcagaaagtacaaaagaaagtgtatcaacagcaattgctgaaacaaaagaagctatgtcaaaacaagtaacggaagttaaagagacagcagctgaaaaagtggaagcggctaaagaagctatgtcagaacaagtaacggaaattaaagagacagcagctgagaaagttgaagcagctaaagaagctatgtcagaacaagtaacggaaattaaagagatagcagctgaaaaagttgaagcagctaaagaagctatgtcagaacaagtaacggaagttaaagagatggcagctgaaaaagttgaagtagctaaagaagctatgtcagaacaagtaacggaagttaaagagatggcgactgaaaaagtggaagcagctaaagaagctatgtcagaacaagtaacggaagttaaagcgatggcggctgaaaaagttgaagcagctaaagaagctatgtcagaaaaagtaatggaagttaaagagatggcgactgagataaaaagtgcagtagaaaaatagtctatattgggttagattttctttaatgattagagctagaatgattgttttctagccttttttctttataaattgagattaagtttgtctttttatccaaatttgttagaatcagtcagaattttggggctgattttggattcgacggaattagcgaagcccaaggtgcacgtcgaggtgcggtaggcctcgtaaataaaccgcaaaacaatagtcgcaaacgacgaacaatacgctttagcagcttaataacctgctcatagccttcactccctagctttcgctcgtaagacggggataaagtggagtcaaatccaaacgagatcgtgttgaagccgccgctttaggatcgaagcattaaattgaataaagctagttttttgatggcgtgtctgtccgcagtcaatttacgaaattaaagattagactaaacgtgtaggactgaaggtagagtaatttcggacgggggttcaactccccccagctccaccatatcattcgaaaagaaaatttctagacattttgaaccgcattgaaaatgccaattttggcgtaactttttgtttttaatctttttagtgaaatttgttaacaacttaattttattaacaaaatttatttggcttttagaaggtttatggcacatcttgttaagatgttaaagaaaaaccgaaagaaaaatatttactaattgatggctaagggttgttctgaaaaactaagtttggcgatgttaaaatttgactaattaactctattagaagctagttatatcataactagcttctcgtttttatctccaaattaaattactttttcttgtaattgtagtttggaatagcggtccagcgttttttgaattctttaacgacttgttttggttgacgattgcgtgagaaaagccctttatggtttccttgtatacggtaaatcataaggtttgtttcaaagtctgcaaaattccatacttgttccccaacaagattagggatgctgtcaaaaacactatggctcatagcataaaaatcacattgaaactcttcggtataaggaatatcccacatagaatgtaagccaggtaaagtatctgcaccatattctgtcataagaattggtttatctgggaatttactttgccattttaacaactcttgacgaagtccagcttctcctttagctaaatcaccatgatctacataccaagcatagtatcgattcaaagaaatgacatctactaaatccattacttcatcacgctctggcgttgccagtaaaatattgactaaggtaacaggacgtttttgcggatccaattccttataaagagcaactaatggtttgaaataatcatgagcacctgcttcatggctggctggttcatttgctactacccacatgacaactgaagggtgatttttatcacgttttaccaattcttgaatcgcttgttcatgtgcttctcgggttttcatagcagaccaagttccgttatctttgggatttaaatcaagagaagcggtaaagttttggaaaagtccaacggctggaatttcatcaattaccaaaactcccatgcgatctgcaagacgcatcatttcttcagaataaggatagtgtgaggttcggaaagagttggcaccaatttctttcaaaaggttcatatccatcaagtttgctgcttcgtttaaaccgcgaccattgataaaagtatcttcatgttttccaaaacctttaaaataaacaggtttttgattgacaaagaattgaccatctgccacatgaacactacgtacaccaaatggctcatcataggtatcaacaactttaccatcaacaagtagctcaatatgtgcggtataaagataagcatctaaaacttcccataagcgtacttgttcgagagtgatatgcccgttacttgattgtgcaactacttgacgatcttcatcaagaatagttacttggattgtgtcaactgcctttgatgtttcaacagcaatagaaagttttgccgtctttaagtcatctgaaagctcactgacgatggtaacatctgaaatgtgaattttaggacgtaccattaattttactgggcgatgaattcctgcatagttgaagaagtcaaagttttctttaaccacttttttaatactgccatcttcttgagtctcttcaatgtaattaccaacaggaagggtggtgtaatctaagatattattggcacagacagagatttttatttgattttcttggtaaagctcctctggaataattacctcaaacggagtgaatccacctttatgagaagcaagttctcgaccgttaacataaattttggcattgtgagttaccgaaccaaagcgtaaaactaactcatcattttccgctaatttgggaatatccacccaacgctcataccaaaaatctccaatataattacgcttatctttgtcaaccaccacgtcattaaaggaagttggtactaccatcacttcttctggtgataaatccttttcgggattatgctctcctagtttaaattgccataaaccactaaggtcatataaacttcttgtttttgttaacgttggatataacatatattttctcctttgtgtttcttaacgtttaatctcgtgggaagtctcatctagcaattgatcaatatctgcttgagaaatcacattaatatcgccttcaatggtatgtttgaacttgaaacttgccatagcaatggccaaacttttttcaggactttcttttttaagcatgccatgaataattcccgctgtaaaagcgtctccagtaccaacacggtctaacacttgaatgcctgatttgtctgtctgataaagatgaccatcctgatataaatagcctttcaatagatattcattagtatgtcccatttctctttgagtaaaagcaaagcttttcacgctataagttttagctaatttatccaaaatgctttttaataattcttgatcttcgtaaggtcttgttaaacctaattggtcttttaaatctccttgcccatcaccggaaagacttaacggctcaattccaatgcaaacatctgctagagcggcaagaggggacaataattctcttgcctcttggaaagagttccataaacttgctctaaaatttaaatcaaaagagacagtgagtccctctgctttagccttggtcatcaaataatgggttaagctataaaggttatcattcaacgctggagtgatgccagacacatgaaaccagtcggctcctttgaatacagactctaggtcataatcactcagttgagattcccaaaaagcagagtgttttcggtcataagttacccgactggcacgtaaggaaaagcctttctggtaataataaatccctagacgttgccctttttccaaaatgtaatcctgattgatttgacgagaaaaaagaaagtttttcgtcatcctacctaaatcattatccggaatggcagatataagagaaacgttgtgtcctaattgtgccaaggttgaaagaacatttaattctgaaccgccaaattgacattctagactggttgtcagtgttagggtttgatactgtggtggtgataaccgtaacaagatttcacctaaagaaactactgttttcaactaaaacctccatcttgatgggttgtgctaaaagtagtatacacgatattatgttttttagtacaagaaagtgggctacagtaaaaaataagttatatcatcatcgtaacagactgcttatttagaattcttaatatctattagattattagattgttattcgcattgatttgtcgataatcttcaatgcagtgatgttttaaaaaaacaagcatattttctttataagatgtttagaaaaatcttttttgttttttgtagtgtggagtgacaaaagtgcggtgtcttttggtgtgtccttagaaatactttacaagtgttgattaaataagttcaaagatagccagcaaaagaattattttagaaatgcagtaaaaattatcatttatgccatagaaatattaacagaaattagtaatttaaattgagattaacgacagaaaatagtaaagtagcccactattcattcacttacaaaaatagcttttaaggcggaatttatgggaaaaagtgttgttgttttaggtgctcaatggggcgatgaagggaaaggcaaaatcgttgatttattaacagatcgagttaagtatgtggttcgctatcaaggtgggcataatgcggggcatacattgattattaatggtgaaaaaacagttcttagattaattccatcaggtatattacgtgaaaacgtaacctgtctgattggaaatggggttgttctttcaccgacagccttaatgcaagaaatgggggaattagaaagtcgtgggattaatgttcgtgaacgtttgttaatttccgaggcttgtccgttaattcttccttaccatgttgcaatggataaagctcgtgagtcagctttaggcaataaagcaatcggtaccacaggacgtggtattggtccggcttatgaagataaagtcgctcgtagaggcttacgtgttggcgatttgtttgataaacaatcattcgccgaaaaattaaaaaatattctagattactataattttcagttagttaattattacaaggttgaggctgttgattatcaaaaaacgttggatgaagtacttgcagtggcagatattatcacagctatggttgcagatgtgacgacaattttagacgttgctcgtaaaaatggcgataacattttatttgaaggtgctcaaggcacaatgttggatattgaccaaggcacatatccttatgtaaccagttctaacacaactgctggtggtgtatccactggagcaggttttggtcctcgtcatattgattatgttttaggtattattaaagcctattgtactcgtgttggtgggggaccattcacaacagaattatttgatgaagtgggagcggaaattgcacggaaaggaaatgaatttggtgccgtaaccggtcgaccacgtcgttgcggttggtttgatgctgttgctattaagcgagcaatccaaacgaattctatttccggtttttgtatgaccaagctggacgtattagatggatttcgtgaagtcaaaatttgtgttggctacaaaatgcctaatggtgaaattgctgaatatgcaccattagcggcaaaagattgggaaggtgtagagccgatttatgaaaccttaccgggttggcaagaaaatacatttggtataacagatgttaatcagttaccggaaaatactcgtaattacattaaacgtattgaggaagttacgggcgtacctatcgcgattctttcgacaggtcctgatcgtgttgaaactatgattttaaacgatccttttgcggtgtaaatcataaataatagagacaaaagtggtttaattcagaaatgaattaagccacttttttatctcaatcaacttcctgaaatcttcattttttccaacaaaatcgaacctgtttgaatattcgatctatattcaatatcgttaccaaccgcaataatatttgcaaacatgtcttttaattgcccggcaatagtgatctccgatacaggatattgaatttcaccattttcaacccaaaatccaaaagctccacgtgaataatcaccggtaataatattaaccccttgtcccattaaatcagtgaccaataaacctgttcccatttcttgtaaaagtgcggttaaattttgtgaatttggcttaaccagccagttatgaattccacctgcatgtcctgtactttgcatacctaattttcgaccgctataacttgtcagcaaataggtttgtaaaataccttgttcgataatttctaaatttttcgtacgaacaccttcactatcaaaaggtgttgaagcaagtttgccaatcaaatgcggtctttcactaatatgaaaccaatcaggtaatatttttttacctagatgatcgagtaaaaaactggaatcacgatataaacttccaccactaatcgccgttgccaagtgtcctatcaatccggttgccacactattcataaaaataaccggcacttcttgagttggaatttttctcggttgtaaatgagatagtgcttttttggcagaattttcgccaacccaaaccgcactttccaactcttgaatattacgtgcaacagtatattcataatctcgctcaagttgttcattgctgcttgcaatcacagaacaagataaagaataacgacttgataaatagctttgtaacatgccgtggctattaccataaactcgcacaccggtatgcgaattaaatgttgcaccttcactgtttacaatgcgtttatcataatctaaagcggctttctctgtttgcaaagccaatgaaacggcatgatcaacatcaatatcaaactcatgataaagtgctaaatccggtgcatcaaatgccattaattccttatcagctaaccctgcacaatcatccggagaggtatatttcgcaatagctaaggcggaatctaccgcactttttattgcggtatggcttaaatccgaagttgaggcatttcctttttgattccccaaataaacggaaatacctaaagcaccatcattgttaaattctacattttcaatttcctgtaaacgagttgaaacggataaaccattgacttttgtaactgcaacttctgctgttgcacctgcttgcgtagcagttttaattgcatagcttacagcatcttgtaacatttgctcttgttgctttaaaagtgcggtggaattttgttgagttatcattataagcctttttattaaacagaaattttggctattttagcttattttcaaatttgtcgctaaccacaaatactatgtcatttcggcaaaatgtgaagttatgctaaaatacgccgaattttacataaggaaaataggaataaatcatggcgaaatgtaaagaagaagtgtttaattgggaagatgaggaacaagaagaaattatttgggtgagtaaaagtgaaataaaacgtgatgcggaagctttgaaaaaattaggtgaaaaactcgtcaatttaaccaaaacaaatttggataaaataccattagacacagggttgcgtgatgcggtcgaacttgcacaacgtttgcaaaaagaagctcttcgccgtcaaattcaatatatcggcaaactcttgcgagccattgatccggaaccaatccaagaagcgttaaataaaattgaaaataaacatcagcagcaacaagcaaaattacataaattagaattattacgagatgaattggttcaaaaaggcaacagtgcatttacagagctattaatacagtatcctcatgcagatcgccaacatttacataacctaattcgttcagcacaaaaagagcgggaacaaaacaaaccacctaaatcataccgagaaattttccaatatttgaaagatctgattttggaagattaacatgaaaatccgcatgttaaagtgcattaacgtttatctgctatttttcacatgtaccaaaatccgctataatggcggacatttttgatataacgtacctaataatgtaaaaaaaccaaagaggtttattatgactactccagtagttgctctagtcggtcgccctaatgtcggtaaatcgactttatttaatcgtctaacacgtactcgtgatgctttagtggctgattttcccggtcttactcgggatcgaaaatatggtcaagcacatttcaatggttatgactttattgtgattgatacgggaggtattgatgggacggaagaaggcgtagaggaaaaaatggcggagcaatccttacttgccattgaagaagccgatattgttttatttcttgtagatgctcgtgctggcttaacttctgcggatgttggtattgctcaatatttgcgtaaacgccaaaataaaactactgtacttgtggcaaacaaaaccgatggtattgatgcagattctcattgtgcagagttttatcaactaggcttgggtgaaattgaaaaaattgcggcatcacaaggacgcggtataagtgcattaatggaaaaagttttgccacctgttgccgacaagctaagtttagctaacgcagaagagcattcagaaagtgcggtagaaaattcagatgaaagtgcggaagaatgggaaaaagattttaattttaatagtgaagaagatatacagctacttgatgaggctcttgtagaagaacaagaagaaagtgaagataaaaatatcaaaattgccattgtgggtcgtccaaatgtaggaaaatcaacactaactaaccgcattttaggtgaagatcgtgtagtggtgtatgacttaccggggaccactcgagacagcatttatattccgatggagcgagatggtcagcaatacactctcattgatacggccggtgtacgcaaacgtggtaaagttcatttaacagtagaaaaattctctgttatcaaaacattacaagctattcaagatgcgaatgttattttgttgacgattgatgctcgtcaaggcatatccgatcaagatttatcgttattaggtttcattttaaataccggtcgttccttggtcattgttgtcaataaatgggacggtttaaatcaagatataaaagatcaagtcaagtctgaattggatcgtcgtttagactttattgattttgcacgtgttcattttatttctgctctacatggtagtggtgtaggcaatttatttgacagtataaaagaggcttatgcttgtgctacaaaaaaaatgacaacgtcattactaacccgcattctacaaatggcaacagatgaacatcaaccgccaatgataggtggacgcagaattaaactaaagtatgcacatccaggcgggtataatccaccaattattgttgtacacggcaatcaaatcgaaggtttgccggacagctacaaacgatatttatctaactattaccgtcgtagcttaaaaattattgggtcaccgattcgtttattgttccaagaaggaaacaacccgttcgcagggcgtcgtaataaactgacaccaaatcagttgcgtaaacgtaaacgtttgatgaaatttatcaaaaaatcaaaacagcgataaatataatataaatgggcggaaaatatccgcccaaaatcactgcactttgcctctatattttttcttattttgcgatctctctcgcaaatatttcccaattcaataaactttcaactttttatcttttatattaaagccttcccacacaaacggatataaggataattatgcgagtatcagcactattttttatgttgttcattataaaagttcaagcaacattgccggatttcatgctgttggaaaactataaaaatcaggacgtaagcggttgggtgatgagtgaaaagttggatggcattaggggatattgggatggcaaacaacttttcactcgacaaaataaagtcattcagccaccgcactattttattcgtgatttcccaccctttgctattgacggcgaactttttaccgaacgtaatcaattcgaaaaaatatcctctattgtacgttccaaaaaagataaaggttgggaaaaaatgaaattatatgtttttgatgttcccaatgcacaaggaaatttatttgaaagactggctgttttacaagattatcttgataaacatcctacaccttatattcaaattattgagcaaattcccattaaaactaaacaacaagtgaaaaattttttacaacaaattgaaaaacagcaaggtgagggagttgttttacgtaatcctcatgctacctatgaacgaaaacgcagtacacaaattttgaaattaaagaccgcacttgatgaagaatgtactgttatagctcatcatcaaggtaaaggacaatttgaaaatatgctaggatcaatcagctgtcaaaatcatcgtggcatttttaaaatcggctcaggatttaatttaattgaacgtagaaatccgcctccaataggctctattattacctataaatatcgtggattaactaaaaatggacttcctcgatttgccacttattggcgttcaaagaaagaataaaagtgcggtgatgattgatataaaatcttcttatggggctgatattttcctttacaagccgtaaaatctgcctaaaataaagcccccaaatagcttgcatagtcaagctactgacttgtaatcagacttaagagaaaatttatgacaactcaattcaaaccggaattattatctccagccggttcgttaaaaaatatgcgttatgcttttgcttatggtgcagatgccgtatatgccggtcaacctcgatatagtttgcgagttcgcaacaatgaatttaatcatgctaatttaaaaatcggtattgatgaagcacatgcacttggtaaaaaattctatgttgtagtgaatattgcaccacataattctaaattaagaacctttatcaaagatttacaacccgtgattgatatgcaacctgatgcactaatcatgtcagaccccggcttgattatgttggtgcgtgagcatttcccaaatattgatattcatctttctgtacaagcaaatgcagtgaattgggcgacagtgaaattctggaaacaattgggtttaactcgagtgattctatctcgtgaactctccttggaagaaatcgctgaaattcgccagcaagtaccggatattgaagttgaaatatttgtgcatggtgctttatgtatggcatattcaggacgctgtttattatcaggctacattaacaagcgtgatcccaatcaaggtacttgtaccaatgcctgtcgctgggaatattctgttgtagaaggaaaaacagatgaagtaggcaacattgtgaatgttggtgaagaaattcccgttaaaaatgtcgcaccgacgttaggtgaaggaaatacaacaaataaagtctttttattagcggaaaatcagcgacctgaagagcaaatgtcagcctttgaagatgagcatggtacttatattatgaactctaaagatctgcgtgcagtgcaacatgtagaaaaactttcacaaattggtgttcattctttaaaaattgaagggcgtacaaaatctttctattattgtgcaaggacggctcaagtttatcgcaaggctattgatgacgcagtagcaggcagaccttttgatgaaagtttaatggatacattggaaagtttggcacatcgtggctataccgaaggtttcttacgccgtcatacgcatgatgaataccaaaattatgattatgggtattctatttctgaacgccaacaatttgttggcgaatttaccggtaaacgtaatgaacaaggtatggcggaagttgcggttaaaaataaattcttgttaggtgatgaagttgaattaatgacgcccaaaggcaatgtggtttttaccattgagcgtatgcttaatcgtaaaaatgaacacattgatgccgcacttggtgatgggcattttgtttttttagatgttcctcaagatattcaacttgattatgcgttactcatgcgtaatttagttaatgcaaatacaagaaatccgcataataaaaaataatcgtttgttagaaattttttgtgaatgtaaaaaatatttcgccctttcttgatgaaagggcttttttaccctctgtttatatcacctaatttatcagacagtgctatcgggcaacgcaagtgctatacccgtagcacttgccgattgccttagtcttgtagcactaagggggtgatttatgttctaaccattcttgacctaatcgcttatctagtaactagattgtcctaagacaatcggaaggggtgaggtggtaactcgccccgacctattcccattgtatgccctatcccctgatttttcaagttatctacttttcaaataatcttattcttaattcgtctagagttttaatttctccagaaacatattttttcagtaatacttcacattctttagatggatattccccttctaatgcaaaactggctaaggcgttttttatatgaaattcccgtctagttaaaatttcaggtgttaatttttcatcatcttgcataaatccccctaaaatttatatttatgaaatttttttctcactaacttagaaagttcttcgtagtcaatttcttctggtttaagagcgtatagcttgttacgcaagccggctaataactcgctatcttcgtttctaccacctgtttgagccacgattaagccgagtgtttgggaaatgccattgattaaactgtctttttccatgagtgttgccataattctcccccttgttttatttgaaaaacctttaaaaataaccacttttatttgccaaagcaccattagaacatttattaaatcaatctggcgtgattttttgtcaagaaaaaattgcttttgatcacgtaaaaagcggaaccattaatgatagcaattattttgtttattatggcaaagtagcatcattggaacaacattttcaattgcaaggcaaaaattatacttgctacgctttttctaatcctccttacccttttgttagaccagcaatttttgatgatgaactcaattttttagagcaagcactctcaaataaaaacaaaattgataaaaagaaagcttttgtattttttaaacgttatgccaatcaaccgatttgtgttggaaacttccttcaaaaactatcctatctcctctattttcgttggggcagtcataacattattggcaactttgattttttctgcactggcatggctcattagttccattattgtcttctggcagcaacgcaaaattccctctgagtatcgacaaaaaatgcgtaaccgagaaccatttcaacgcttatcgaaaattgtgccacttgttttttaggtgcgggtatttatggtgcggtcgccactcacgatattctgtcaaaatggaacggatttccacaacctcagatccaacaacttgctacgcagtattgctcagccaattggtgccaaaatctttccaaaatcaacatcaaaacaaggacgctacccgctggagtttatagtgcggaagaaaaaacgcgtattattcaaaaaaccttagtcaaaaaaggttacaaacttaaagtggacggaaaatttggtacaaaaactcgcaatgccgcagtaagttaccttgcgaccaaaggtatcagcgtcactaacgatatcgccttggatcggttgtttgagtattttgaaccaaacttacagtaaaaaaaattattttgaagtactgtatattgatagaatgtttattctaatatatagctttttatatgacttaaactctttttaacgtgcctatttctttgctttaattacagatgttcttgtatattatagtttttcatatctgtgatatttatcacaaaaacgaaataaaaattccaaattttaataaaaatgaaaattttgcattgaaataaaagtagcaatattgtattaatatcaaggtatttaagtggttcaatattacagtctgatcactaaatagagaagttcattgctaaatttaatatttacatatgctaaaattgataggaaaattctatgaaaactgcaaaaaactgcaaaaaactgcaaaaaactgcaaaaaactgcaaaaaactgcaaaaaactgcaaaaaactgcaaaaaactgcaaaaaactgcatagcattcttttaactacgctacttatctcccttcctgtactatcacaagctaaaaccctaagattggctcatcatatggctaatgataatgttaaccatacactagttatagatttttcagacaaactcaaagaaatatctaatggaaaacttactgttgatgtttactcaaacgggattttaggcgatcaagtggagctatttgaaggaatgaagctcggtactgttgatatgtccatctcagatactagcatcattgcatcttattattctccaattgggattttagatatgccttatttttttaaggatatggagcatattaaaaaattactaaatacagccaaaatggcagaaattaaaaaacaagttgaagccaaatcaggggttaaaatattaagtattcaacctgtcgcttatagaaatattattcttaaaaaagaacttgctgataataataaatttgatggcttaaaaattcgagtaccaaattctcctgtacttgttaataccataacttctcttggagctacaccaagtccaattccatcaggtgaggcatacactgctatccaaacaggagttgtggatggtatggaaggtaatccggaatttttaagctccattaaaatcagcgaagtagctaaaaactggtatgaaacacaacatgccatgacctttactgcgttaaatattagtgctaaaaaatttaattcattaacggaatctgaacaacaatggattaaagaggctgtaacttttgcaatagatcagttttatattaagactgtcaacactgatgaaaaatggagaagttatctaaaacaacaaggtgtcgagtttcataatgtagatataccaactctaagagaaaaagctaaaccaatggttgataaatttgttcaagcgaacggattagaagaattatataaagaggcacaaaaatgaaactagatggttatatttcctcattcagaaatacattaacgattatacttttttctgcacttgtcattgttgtatctataggcgttttttctagatttttaacatcacatcctttcgcttggactgaggaattatctagatttatttttatttggctagcttggatagcttcaagtttaacaattgctaagggtattaatattacctttgatattgtgctggataaattagaacaaaccgttggtagtattgctcatattattgtgaatgttatttctgtcatttacatactcgcagtcattatcttgggatatatactttgtattaataatacaaattcatactcccctttactaggtgttccaatgtggactctaaatcttgcgatacctgttggtggggtattgatggtttatgagcaaattaaaaatttaatcaagaaacgttaattataatgaggtgatatatgctacttcttgcattcttatgcttctttattttggttctgctcggtgtgcctattgcattttcaatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagcagcagatacagccgccgtcggttcaattatgatacctaccatgaaaaaaaatggctatccagcaggcttaactgcagtccttcaatctgtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagagccattttatgcaaagcatttaaagaggcgtcttctgcattatttatgccggttatcatagtaggtggaattttggttggcttctttacgccaactgaagctggggctgtagcagtactttatgctattgcagtcggtatttattataaagaattaacttttaaaaaattcaaacattcaatactaaatgcagccgcaatgaccgcaatgtgtaccctaattatatcgggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgtggtcttagtttatgcaggtgtaacacctcctgtcggtggagtattgttcattaccatggggattgctaatgtcaaactacaggaaacgctaaaatacctcgttccttatttaggtgtcatattcatcgttgtgttactgatgatattattcccttcgatctctttgatgatacctaatatgttccgttaaaaaacaagtgagtataatgtgtttttcattttactcacttgatggcgataatgacacaatttcctcttgtatgaacccatatttgcgactagactacgcccttacagtttttattatgattttacgaagttatgtatttatctgatttctattttgacttacctgatgaattaattgcacgttatcccaaacgtgagcgttcttccagtcgtatgttgcaattaaacggacaaaacggagaattatttcaccgcacttttagcgatgttgcagatctgattaacgaaggcgatttgctgatttttaataatacccgagtgattccggcgagaatgtttgggcgaaaagcaagtggtggaaaaatagaagtgttggttgagcgggtattaaatgaacatcattttttagcccatattcgatcttcaaaatcaccgaaagaaaatacagtgctttttttaggtgaagataagctgggagaagggaagggtgttgaaatgctgatgaaggcacgccatgaaaatttatttgaactggaattaagtgataaaagtaccgctcttttagatattttacagaaaataggtcatatgcctttacccccttacattgatcgtccagatgaagatgccgataaagaacgctatcagacggtctacaataaagttcccggggctgtggctgcaccaactgccggcttacattttgatgatgagctattgacacaactcaaaaacaagggggttaattttgcctttgttaccttacatgtcggtgccggcactttccaacctgttcgtgtagaaaatattgaagatcataaaatgcacgcagaatatgtggaagtcccgcaagaagtggttgatgctgttttagccacaaaagcaaagggtaaacgagttattgcagtaggtacaacttctgtacggtcaattgaaagtgcggcactttttgccgaagaaaataatagcactcatttacttgaaccctatttttccgacacttccatttttatttatccgggcaaaaaatttcgtgttattgactgtttgattaccaatttccatttgccggagagtactttgattatgctggtttctgcttttgccggttatcaacatacgatgaatgcttataaaagtgcggtcgaaaatcgctatcgcttttttagctatggcgatgccatgtttattacgaaggcctaaaagccgattacatcagactgtttatctgacgagaaggattacaaatgacaatgaaatttaccttacataaaactaacggtatggcacgtcgaggtaccatgacttttaatcgtccgcagggcgaatttacggtggaaacgccagcttttatgccggttggaacctatggcacggtaaagggcatgacacctgaagaagtgcgggcaacaggggcagaaattttactgggaaatacctttcatttgtggcttcgcccgggtcaagaaattatgcgtcaacacggtgatttacacgattttatgcaatggcatcgtccaattttaaccgatagtggtggttttcaagtttttagcttaggtaaattgcgtaaaattactgaagaaggtgttaaatttcaaaatccaattaatggcgaaagaattttcttatcaccggaaaaatctatggaaattcaatatgatttaggttcggacatcgtgatgattttcgatgaatgtacaccttatccggcaactttcgattatgccaaaaaatccatggaaatgtctttacgttgggcaaagcgtagtcgtgaacgttttgatgaattaggtaataaaaatgccttgttcggtattgtacaaggcagtacttttgaagatttacgtaaactttctattgaggggttaattaatatcggttttgacggttatgctgttggtggattagctgttggagaacctaaagaagatatgcacagaattttagcatatgtttgcccgcaacttccggcggataaacctcgttatttaatgggtgtcggtaaaccggaagatttggttgaaggtgttcggcgtggtattgatatgtttgattgcgttatgccaactcgtaatgctcgtaacggtcatctttttgtcagtaacggtattgtaaaaattcgtaatgcaaaatatcgtaatgacacaacctcccttgatcctgaatgtgattgctatacctgtaaacactataccaaagcttatttatatcatctggataagtgcggtgaaattttgggggcgagattaaataccattcataatcttcgctattatcaacgtttaatggctcaaattcgtcaagcgattgaagaagatcgttttgaggattttgttgtagaattttataaaaaaatcggtaaatctgtgcctgcacgataagaaagtaataataattgtcggagaaataacctacaaggtcggttattgataaataaagtgcggtgaaataaaaagatattttcacattaaaagaattttatgctattttacgcaagtttttaatgaatgtttaactcacttataaggataaaataatggaagctcaacaaagtagcccactttctatgttatttatttttgccatttttggattgattttctattttatgatctatcgtccacaagcaaaacgtaacaaagcacataagcagttaatgtctgaattagcgaaaggcactgaggtgttaacttcaggtggtattatcggtaaaatcagcaaaatcagtgctgaaaacgattatgtcgttatcgcattaaatgatacaactgaaatcactatcaaacgcgattttatcgtagccgtattgccaaaaggttctttaaaatctatctaaattttcattcattccgcaagggaacaagtctatgttaaatcgttaccctttatggaagaatctaatggtgatcctagtgatcgccattggtgttttatattctcttccaaatctttacggtgaagatccagctgtacaaatctctggaacacgagggcaaaccgctgatataaacgtgcttactaatgtacaaacattattagagcaaaataatttacctatcaaatcaattattttggaaaacggctcaattttagctcgtttcaacaatacagatgatcaacttttagctaaagataaaattattgaacaacttggtaataattattccgttgcacttaaccttgcacccgccacaccaaaatggttaaccaatattggcggtagaccgatgaaatgggggttagacctacggggaggtgttcgtttcttaatggaagtggatatgcacactgcattggataaacgccaagaacaattacaagacagcttacgtaccgaattacgcaaagaaaaatatcaatatacgtctattcgtaatggagaaaattttacaactctcattaccttagctaaaccggaacaactttccgatgtacaacgtttcttgcgtaaacaacatcaaaatctgaacgttaatgccatttctgaaaacacactaagtttagaattatcagagaacgctctaagagaaattcgtgatcatgctattgaacaaaacttaagtattttacgtcgtcgtgtagaagaattgggtgttgctgaacctgttattcagcgtcaaggggctgagcgtattgtagtggaattacccggtgtacaggatacagctcgggcaaaagaaattctaggtgcaacagcaacgctggaattccgtttagtaaatcaaaatgcaaatttagatgtcgctcttaaaggtatggtgccttctgattcggaagtgaaatatgatcgcaatggtagtcctattgtgttatatcgacgagctgtattaggcggtgagcatattactaatgcaagttcaggcatagatcaaaataccggttctcctcaggtttcggttactttagattctgaaggtggtgaaattatgtcacaaactaccaaacttaatctaaagaaaccaatggcaactctatatgtagaatataaagacagtggtaaaaaagacgaacatggtaaaactattttagctaaacatgaagaagttattaatgttgcgacaatccaaggtcgtttcggttcacaattccaaattaccggcatcaatagccctgctgaagcacaaaacctatcggtattactacgttcaggtgctttaactgcaccaattcaaattattgaagagagaacggtaggcccatctttgggggctcaaaatgttgaacaagggctgaaagcaggattatggggattagccattacgattatatttattctattttactataaactcttcggtttatttgccggcatagcccttattgccaatatgatacttcttgtaggtataatgtctttattacccggagcgactttaacaatgccgggtatcgcagggattgttttatctgtcggtatgtctgttgatgctaatgtattgatttttgaacgaataaaagaagaaattaataatggtcgcacaattcagcaagctattaatgaaggttatagcggtgcatttacgagtatttttgatgcgaacttaaccactattctaacatcagtcgtattatatgctgtaggtactggaccggttaaagggtttgctattacactctctttaggtgtagcgatttcaatgtttactgccattacaggaactcgttttcttgtaaacttaatctatggcggaaaacgtgttgaaaaattatcaatttaaggcaggtgaatagtgagtttatttacacgcaataaaaaagtgcatgaatataaaggggtcattttaccttttaaactaaccccttttatgaaataccgctactggggatatgctttctctatcattgtaactgcggtctgttttttctttatttttactaaaggattcaactggggactggattttaccggtggaacagtgatcgatacccatttttctcaaccagcagacctcaataaagtacgatctacattaaaagagaatggaatagaaagtgcgttggtacaaactacgggaggtgttcgagatgtcatgatcagattacctgtcgtagaaagtagtgctgaagtgggtaataaaattaaaactatcctcaatagtttggatgaaggtcttgaaattcatagtattgaatttgtaggtccgaatgttggtgaagaattaacacaaggtgcaatttacgcaacattagcaacattactgatgttattaggttatattgctttccgtttcgaatggcgtttaggtacaggagcagttattgcccttgctcatgatgttattgtcactttaggtgttttttcctacttccaaattgaaatggatcttaccttcgtggctgctatcctgtctgttgtaggatattcgcttaatgatagtatcgttgtttttgaccgagtgcgagaaaatttccgtaaaattcgccgtattgatactgttgaaattattgatatttcattgacccaaactttggcaaggacattaatgacatcaatcacaacattatttgtcgtaattgcactttttgctttcggtggaccaacaatccatagcttttcacttgcgttgttaatagggattgcttttggtacttattcaacgatttatattgcaattactctagctcttgatttagggctaaaacgtgaacatatgctaatccaaattgttgaaaaggaagagtttgaagaaggcttctaaactcatgttgtcgggcatttgcccgacatttagaaccaacaaatcaaaacactggaaactgtttaaaaaaataacaatgaaaaatgagtggtaggatttttcacaacaagagttgtttaacacgagtttttttggttcaaaacgttagtcatgtttttcttatgttattctcatcaaaaacctatctgtatcatcttaaggtcgaataaatcgaataagcaagcatagtaatcggtcaaaaagtgcctactgtcttgctttgaaaaaaaagattgtctttctcaatataacgtattgctatgtatagactctactacacgtttttttggtagacggtatgtattttaggcgtgaaaatttttagaagtatttggaggtaattctaaaatcttagttttggagagcaaacggaaaagacagaattattgaaattttaagtagcgattttggggattaacgaggtaactttttggtgctctgagcgagacttgaactcgcacgtcctacggacactaccccctcaagatagcgtgtctaccaattccaccaccagagcgtaatttgaatttaggtttttattgaggaatgtcgctgttttttgtgtcaggtgtcggtatgctttgttgtttttcctgaacttgctccgcaacttttgataaatcatcaaacttaccacttttaacattattgctatgtgaattgatattaccaatcaataaactgatagcaaaaaatgctgttgccaaaatggctgtcgtacgagataagaaattgcctgcacctgctgaaccaaaaactgttcctgaagcaccaccgccaaacgaagcccctgcattagcacctttaccttgttggattaagatgaaaccaatgaggacaatggcaataactaagtaagcgatcagtaaaacttggtacattatttcttctctctaaattcaaacatttctataaacaaaataacgtgcgaatactatctaatattggaaaccttcgcaagtggttttgataaaaattcggttaattgttttaatttcaggcaaaatttaaactgtgtttactcattttttttcaaatctgcttttttattctctttcgtttgaagtcctagtttccgcagtgcggaaaaattaaagtaacctaataattcaggtaaaagttcactgagcgtttgcataaattgttgataggatccttgcctgcggctaatgctgtccagttgagcttcccaatgtgcggtcatatccggctgagttgcgatttctggtaaggcttgaatgagtgttctgcctgtttctgtactgtgaatattccgcccttttttatagatgaatcctcgcttaaataataattcaataatgcctgctcttgttgcttccgtacctagaccatctgtttcacgtaagatttttttcaattctttattttgtacaaaacgtgcgattcccgtcattgccgaaagtaaggttgcatcggtaaaaggttttggcggttgtgtttttttgctaattacatcacctttttcacaaaataattcatcaccttttttcacaataggaagcaaaggttcttgttgttcatcttcatcctcttttccccaaagttgtttccagcccgcaatttgtaaatttctcgcttgagcaataaaagttcccccagcaatatctaatgtaattttactttttcgatattcagcctcttgacaaaattgcattaagtattggcgagcaattaaatcatagatttgttgttcattttggcttaaagacacagttttattttttgccgttgggataatggcatgatgtgcttctacttttttatcgttccaacaacgatttttcagctcagtattaactatatcgggaatttctttatataaaatactgtgtgtggaaattgcacgtaaaatagtatgtcgtgcggaaaaatgttcttcaggcaaatagcgacaatcggaacgtgggtaagtgattaatttatgggtttcgtataatttttgacaaacatctaaaacctcttgtgcagacatggcataacgtttcgctgcatctatttgtaatgcagaaagtgaataaggcaaaggggcggtttctttttctcttttatcaatatattctgtcaccgttgctggctgtgcggtaatgcgttttactacatttttagctaaagcgttggataacacccgtccttcttcatcttgataatcttcacaggctttactcggttgccaaagtgcggtaaatgttgagggcattttttcttttgttgcaataaaggcttgaacctcaaaaaaatctttcggttgaaaatgctcaatttctaaatcacgacgtacaattaatcccaagacaggtgtctgcactcggccaacggatagaacaccgttatagcctgattgacgaccacgaatagtgtaggctcgggtcatattaatgccatataaccaatctgctcttgaacgtgctaatgctgatgtagcaagggggataaaatttttgttaggctgtaatttttttattgctttttctaccgcacttggattgagatcgttaattagacaacgttgaatttcggctaattttgtagcaggcaacttggcataactgaaaacttcatcaactaataattgcccttctcgatccggatccccagcattaattataatgtctgcttgatgaattaatttaagtacaatgtccaactgactttttacttcttgtctgggaagtaatagccatttttgcggaataataggtaaatgttctaaacgccattgtttgaacattggattgtaaacatcaggagcagcttgttccaataaatgtcctacacaccaagttacataatcttgttcgccacatttgacaaagccttgtccacgttgatgaggtttaggcaatacgtcagcaatagctcgagcaaggctgggtttttccgctataaataatcgcattagactactgattctagggattgatgaaagccaaatattctaacataaagtcaggctattccaaattcgctaaattttcgctaaaatgccttgcgttttttgattaacttagatggaagaaaattatgttcggaaaaggtggtttaggtaacttgatgaagcaagctcagcaaatgcaagagcggatgcaaaaaatgcaagaagaaattgcacaattagaagtaacaggcgaagccggagcgggtttaattaaggttacaatcaatggtgctcataactgtcgtcgtattgatattgatccttctttaatggaagacgataaagaaatgttagaagatcttattgcagcggcatttaacgatgcagtacgccgtgcagaagaaatgcaaaaagaaaaaatggcatccgttactgccggtatgtctttacctccgggatttaaaatgccgttttaaattaattcatatatgaccgggacgcaatgtttgcgtccgtttttttaataagataattcattatgcaaagcagtcctcttttagaaaatctgattgaacatttacgctgtttacccggcgttggtcctaaatccgcacagcgtatggcatatcatttattgcaacgtgatcgtagcggtggtatgaatttagctggtgctttaaccgaagcgatgtcgaaaattggtcattgtactcattgccgcacttttacggaagaagagagttgtgcaatttgtaataatccaagacgacaaaattcgggttttctttgtgttgtggaacagccttccgatattccggctattgagcaaacagggcaattttccgggcgatattttgtgttaatgggacatttatctcctttagatgggattggtccgaaagaaatcggtttggatttattgcaaaagcggttacaacatgaaagtttttatgaagttattttggcaaccaatccaaccgttgaaggcgaggcaacagcgaattatattgcggaaatgtgttttcaacataatataaaggtcagccgtattgctcatggtatccctgtaggaggggaattggaaacagttgacggcacaactttaagtcattcacttattgggcgtcgtgaaattcaactataacatggttgacgtcctcccccgactttaggtggggaggatgtcaatccttattttatcgttacacgtgcgaattttcgttttccgacttgataaactgcggtggaaggtgaaacaataagttttgcattgtcgactttttcaccattaattttgaccccaccttgctgcaccatacgaatagcctcagaagttgagccaacaagtccagcatcttttaataaattcgctaaaccgatttcgccggtaaaggtaaattccggcatgtcatcaggtattgcccctttttgaaaacgatcaataaattcttgttctgcagtatctgcatcatcagcactgtgaaagcgtgtaataatttcttttgcaagtaagattttgacatcacgtggattacgaccgttttcaacatccttttttaattgtgtaatttctgtgagcgggcggaatgacaacaggttataccaatcccacataagctcatcggaaattgacatgattttaccaaacatattacttggtgtttcggttacgccaatatagttaccgagagatttagacatttttttctcaccgtccaatccgactaataaaggcatagtaattgcaacttgaggtttttgtccgcaagatttttgtagctcacgccccattaataaattgaaggtttgatctgtaccgcctaactcgacatcggcttctaaatgtacggaatcatgaccttgtaaaaggggataaataaattcatgaatggcaatcggttgattattgttaaatcgttttttaaaatcatcacgttccaacattcttgcaacagtataattcgatgccaaacggatcattcctattgtacccaacttacctaaccaatctgaattgaatacaacttgtgttttttgtggatccaatattttgaaaatttgtgttttataagtttccgcattgcgtaacacatcttctcttgataaagggggacgagtagtattttttcctgaaggatcgcctactgttgcggtaaaatcgccgattagaaagattacttcatgaccaaagttctggaattggcgaagtttattaagtacaaccgtatgccctagatgaatatcgggtgccgttggatctgcacctaatttaatgcgtagcggacggttttctttgagtttttcaatgaaatcctgttctgaaaaaacatgatcaacaccacgtttcaattcggcaattacagtatttatattagtcattatgaatccttaatttgaataatattaataagttttttattttccttattatagggattattgattaaaagaaaagtccatagaatataaggttgtcgtaataattcatttttttctcggcgaccaaagtgcgaataaaaaaagcggtcaaaaagtatttccttttgaccacttatcttctattttaaagactagaatttataatttacacccaagcggaattcatgaccacgtgctggaagcgtgttatcatttccacgttgtgcatgcgatttgtaatgcttgttcataatattatcaattgcaaagttgacattcatgctgtcatcgttaaacggtttccagttgattgtcaggtcagttacattataaccaggtttgcctttacccggcgtaacgttaccccctaccagtaagaagtcgtctttagctttgactttttcaacaaggcggtgatgtaaaccgatttcaatattaggttcctcgaaacggtaacttacagatgccgtccatgtgcgacccatcgcagaagcgtattcaggattgccgcttagtagtggtttgttattttcgatgccgccactttttttggcttttttgccaagattggtgtagaagcgaggtttgctgtcggcgacaccaagacgagcggtaaagccaccttgatggtaaccgaaattcaattcataaccgcggtttttaattttgccagcatttaagatgctctgccaaccaccatgattcgagtggttgtcgcgaccggcggttgtgcctagggcatctttgatacgttgccagaaatagctaccgtctacactgaacgtaccgttgtcatagttaaacccgatttcagtggtgcgtgcctgctcggctttggtgccttcaagaatactggttaaaccacgattttgaccatgacttaaaatggcatcttgcatacgtgggctacgggtagcgtagttatgactcgcactaaagcttagctcaggggtggcttcgaaaatcacgccgatactcgggttaaaacttgaatcactgacttttttgccgtccatcgctttaaaggtaaactgatcatagcgtaacccggttgttagcgtaagctggtcagtggctgctgttatggcttccacataaaaaccagtatctgatttacgttgattagagatacctccggctttaaagtgcggtttggactcttgatggcggtagttgataccgtatttcacgagtacattgtgatgaaccggtaaatcaaaattgacgtttgctccttgggtcaccactttgatttgagtggcaccttctctattgccggcataaccattgcctttgtcattggcagaccaacgaccatgtactaaacgataaacattgacagtggcttctttggcaaagcctaagtttttccctgtccattctaaattggtgttatcgaccgtcattttgcgtgcagcgggggcttgtttgtttggattaaaattgacaaactcttcacgcaccaaacgatcgccttcatgttgttcgtgcaaatggctcaagacaaaacggtgatcgccgacggtagcaccgactttggcgaggtagctgagtttatttaaatcgctgtacaagacacggtcagatttgtttactgaatcataataacctttaccggctttgtaattgccgtctttgacaaagtttgttgcgattaacgcatcaaacatcccgctttttccatatacggtggcattataattttgagagtaattggtgctgaagcctgtgccaactcttgcaccgaagtttttatcactgccttccagtaaatctaaggcatctagggttttggcaacaatcgccccgttggtttgaccgataccagctgaagcactacctgcccctttttggacagacacaattttgaccatggcagggtctagcatatgacgaccttgatggtagtgaatttgtgcatcagaatacgcattgtccactttaacatcaatggagttttgtcccataccacgaatataaaggtattgagaagtgccgttaccccccccctatggcgatagatggctcgtttttcagtaaaccgcgtaaatcggtttccgtactttcgtctttgatttgggtggtcacgacattggttttgacttttaaaccttgatgatttgtaacattgatggtgtctaaccttgtagtatctgcttgagcaaatgtatttgcggcaaacacaccaaatactagagcgggaataggcagcaatttaaactttttcatttgatttccttaatataaaaactttagaaacatattctaattcttatattgaaaattattttcaatgataaaaacggcgtgatactaacataatttaattttattgcaaatatttctcattcaaattttcacataaatcaagcgttaactcgttgagcaaggaaatctaatacctgctctttagcaattatttgtttttcacccgtacgacgatttttatattcaatttcgcctttttctaaatttttttcaccaataacaatcatatgaggaacacctatcaattctatatccgcaaacatcactccgggacgctcttttcgatcatcaaagataacatctacatttttattgagtaagctctgatacaattcttcagcaaaaatttgtacattttttgacttatacatattcattgggataattgccacagtgaacggtgcaatttcatcagaagaccaaataattcctttttcatcatggcactgctcaatagttgcagcaacaacacgacttactccgatgccgtagcaacccataatcatcgtttgtgggcgaccatcttcaccttgtacagttgctttcattgcctccgaatattttgtacctaattggaaaatatgcccaacttcaatacctcgcttaatctgtaaagtacctttgccatcaggacttggatcgccttctacaacattacgtaagtctgcaactttaggtagggcaacatcacgatcccagttaacattaaagtaatgtttgccatcaatgttcgcaccagtgctgaaatcgctcatgagtgccacggagcgatcaataatagccggaattggtaggttcacaggccctaacgatcctataccggcaccaatttttgtttttatttcgtcttcatttgcaaattctagaggatcggcgacttccggtaatttttgtgctttgacttcgtttaactcatgatctccacgtacaatcaatgcgataagaggttggtcttcatttgcaccttttacgatcagtgttttaactgttttttccacagataaattaaattgttcaactaagtcattaatagtttttgcatttggtgtatctactaactccatagttgcactcggtgcctggcgttgacctattgctacggcctccgccaattcaatattggctgcgtagtcggaattgcttgaaaaaacaatatcatcctcgccactttttgccagtacttgaaactcatgagatgcactgcctccaatagatcctgtatcagcttgtacggcacgaaaatctaatcctaaacgagtaaaaatattattgtaagttcgatacatgacatcataggtattttgtaaacattctttgctggtatggaaagaataggcatccttcatcaaaaattcacggccacgcattacgccgaaacgaggtcgcacttcatcacggaattttgtttgaatttgatataagttcaatggtaattgtttataagaactgacttcacgatgcaccaaatcggtaataacttcttcgtgagtaggccccaagacgaaatcacggttgccacgatctacaaaacgtaacagttctggaccatattgctcccagcgttgggactcttgccatagctctgccggttgaacaacaggcatttcaacttcaattgcaccgctcttattcatttcctcacgaacaatattttccacttttttcaaaacacgtaagccggtgggtaaccagttatataagccggatgccaaaggtcgtatcatacctgcccgtaacatcaactgatgacttactacttgagcatcatttggggtttcttttaatgttgataataaatatttactcgtacgcatttttgttcctatatttcatgatcttgaatgaaaaaattggtgatagtgtaccattgagtactattggaaaaaaagtaaaagggataagaaagtcatattttttagtcaagggaatagttatcctttccggtagcgacgtaatttgcgaagtcattatgactaaatccatgagaaagcatataacgccaaattttttgtttagccctagaatctaatttatcacgatagtaaggaaattttttatttaaaacctgtaatactatttcgttccaatcaatttcactttcttgctcaatttcgttaattagttctgctggaatgccttttagctgatacaattcctgtctaattcgctgtaaaccataaccacgttttgcacgataataaaggtaattttcagcaaaacgtttatcattttgccagtttttttgttgacagtgggtaagtgtttgagtaatttcttgctcagtaaaacgtttctcctgcattttgcaacgaagttcaaattcactatattcacgccgagcaagtaaaccaatcacataacttaatgcgagcgaagacatatatttattttcctttgtagttaaatgtagataaagagaatacggacggaagaaagtgcagtcattttaccgcactttctatgatgagagctaaatactcagtactaattaaaaatcactttcaacttcagatatgtttgattctgattcagcttcaagatccgctaatagtgctttttccggatttgctaataattctgaacgtaatttttgctctaaaatagcagcttgctcaggatgttcagctaaccatttcatcgcatttgttttcccttgaccaattttttcgccctcataggagaaccaagcaccggatttatttactaacttatgttttacgccaagttcaataagttcaccatttcttgaaataccctcaccgtataaaatttggaaatcaacttggcggaacggaggtgcgactttatttttaaccacttttacacgagtttcattaccaatgacttcatcaccatttttgatactgccaacacgacgaatatcaagacgaacagaagcgtagaattttaaagcattaccgcctgtggtagtttctggattaccaaaaacaacaccaattttcatgcgaatttggttgataaagacgaccaaacaatttgagtttttgatctgccccgttaatttgcgtaatgcttgtgacataagtcttgcttgtaaaccaacatgagtatcacccatttcaccttcaatttctgctttcggtgttaaagcggcaacagagtcaacaatcacaacgtctaccgcaccggaacgaacgagagcatcacagatttccagtgcttgctctccgttatccggttgagaaattaataactctttaacgtcaacacctaatttagccgcataaattggatcaagtgcgtgttctgcatcaataaatgcacaggttttacctgctttttgtgcttgtgcgataaccgatagtgttaatgtcgttttgcctgaggactcggggccaaaaatttcaacaatacgtcccattggtaagccgccgatacctaaagcaacatccaaactaagtgagccggttgaaattgcttcaatatccagtttttgggtttcccctaatttcataattgcacccttaccaaattgtttctcaatttgtcctagagcggcttcaagtgcttttgctttttcttctggggttgccatgttatacctcaaataaattatctatcagaatttatatataatattatactgtattcacatacagtgcaatttaaaattttatctttttagaaattttgcgatctcatcagcaaaaagagaaaattattctatattattaatcaaattttctaatgcttcttgcattgtgaaccatgaaatttctatatcttcaagtgcttttttaagctgaacctgttcatttaaaagtgcggtgagttttgctttattttctgtctgataaagcactgtatcggaaagaagtaattcaatttcttgtagtttttgttgatatatttgcattttgcgttcaatatcggcaatttcttttcgtaatggtgcactccgttgacgcagttcagcttcttttcttttttgttctttgcgatgattaccggtgttttcgttattattgatgattttctcattatgtttcggcgtgctattaatttcatttagccatttttgatagtcttctaaatcgcctgtaaattcctcaacttgtttatcatgaaccaaataaaattcttctactgtattacgcagtaaatggcgatcgtgggaaaccacgaccagtgaaccttgataatctattaatgcttctgtcaaggcttgacgcatatctaaatccaagtggttcgtcggttcgtccagcagtaataagtttgggcgttgccaaacaataatagctaaaaccaagcgagccttttcaccgccggaaaaagaagaaacagcttgagttactttatcaccatgaaaagcaaaactgcccaagtaatcacgtaattgttgttccgtttgttgtggagcaattttttgcatatgccagagtgcattttcttccgaacgtagcgtatccaattgatgctgtgcaaaataccctaattttacgccttttgctaattggacatgaccggaaagtgcggtcagttcccctgccaataatttaattaacgtagatttacccgccccatttttaccgagcaacccgatacgagatcctggtactaaattgagcttaattttttgtaaaatttccaccgtactttctccattgtcataacctgcactggctttttcaatggaaaccaagggattgggtaaagcgagcggttcacgaaatttaaaggtaaaaggattatctacataagcaggtgcaataagttccattcgttctaaggctttgactcgactttgtgcttgtttggctttagttgctttggctttaaagcgatcgatatatttttgtagatggtttattttttgttgctgttggcgataaagtgcggtttgttgtgctaattttgttgcacgttgcacttcaaaggaagaataattgacactgtattcatgcagtttatgttgttcaatatgaatgattttattcacaataggatcaagaaaatcacggtcatgtgaaattaaaatcaaggtgccttgatattgaattaaccaacgttctaaccaaatgacagcatctaagtctaaatggtttgtcggttcgtctaataagagtaaatcagagcgacaaagcagggcttgtgcaaggttaagacgcatacgccaaccgcccgagaaagatttaaccgttcttgttaaatcctcttgagaaaaccccaatccatgtaaaagagaagccgctctcgcttgaattgtccaagcatcaattgtgtctaattgtgcatgaatacgggcaatatcattgccatgattattttcggtagcagttgctaaggccttttgtaatttgcaatattcacgatcgcctttgataacataatctaacgcacttatttctaaggcgggtgtttcttgatttacccaagccattgcccagtgatttggaaaagttatatcaccttcttcagcactcatttcttttttgagtagtgcaaataaagaagatttaccacaaccattttttccgactaagccaactttttgaccggggttaatagtggcacaggtattttctaagagtaaggtatttccacgctttaaagttaaatttgtaaaaaggatcattagataaactcactattgattaataccgatatctccactcataaatcggaacataattagaggtgaaacctgatgagttgagcaaaggtgaagatcgtacatataacttgcaatgcttagatcgatcaaccgcaatatcgtttttagtctagtcgtgacgatctaaaaacgattgcttatattcgagttagtcgtcacgctaggaaagatgatttggttcgtaaagttcgaagtaaaaaactttacaaaatatccaataattccacttcaaataccaacgtgctgaacggtggaattgatgcaccggcaccacgttcaccataagccaaatgatgtggaatagttaatttccattttgaacctagcggcatcatagataatgcttcaatccaacctgcaattacgccacttactggaaattcggctggttgcccacgtttgactgaactatcaaatacagtgccatcaattaaagtccctgtataatggacacgaacttgatcttgacgagttggaattgccccactgccttctaccaacacttcatattgcaaaccagagtctgttacttttacactgtcttttttcgcattttcttcaaggtattttttaccttcttcttcaatttgcttaaattgtgcttgtgcaatttcgctggcttgttgctgtaattcctgtaacgctttagcaacttcgtttaattctaaagcgggcggattttgattcaatgcgtcataaatcccttttgcaacggcttcagctttaaccgctaatttgctatcgactaattgttgaccgatttgtaaaccgataccataactaccttgagctgaaacatcatctaaggcaacctgtgcaaaaaattgttttgtcattgttttccctttattgtcgttgaaaattatttcttataagccaacacttcgcctacacgtacaggcacaccaacgtctaaatggtttgccagttctaccttatccgcttggaatagattgatcactgttgaacctaactggaatgcccccatttcttgtcctttacgtaattgcaccgcactttcgtcgctataagtccactctttcacttcagtgctgcgtggtggattaattattccagcccaaacagtactcatactggcggtaatagtcgcaccgactaaaatctgtaccatcgtgccgaattccgtatcaaaaacacagatcacacgctcattacgagctaataaattaggaatatgctcatttaaaaacggattgaccgaaaataaatcgccaggcacatagatcatcttacgtaaagtagcatcgcaaggcatgtgcactcgatgataatctcgaggagaaagatagattgtagcaaattcaccatgttcaaattctttagctaattcagtatcgccggccagcagatccactaagctaaaactatgtccttttgcctgcaacaaagtttgttgctcaatatgtccacattgactaattcgtccgtccgcaggtaaacaaagtgcggtaggattttcatcaatttttcttgcttcagatttcagtgggcgaataaaaaattcattaaaacttgcgtaatccttaaattctgttttctccgcctcttgcatatttacatgatattttttagcaaaaagtttaataataaaatgcgttacacttccccatttttgttttgccagccagccagctgccagagttaaataaagttgtggcatgacatattgaaaagcaattttcaaacgttgccaataagtcggttgttttttttcagcattatacataacaggtttccttgtaaaaattggacgaggattataacaagttattggtgtaatgtaaccagcagaagagttattgtttgtcgtagaggggcggttttaatctaaagttaataaatagacgttaattatgaattggttaagtcaagcctattattggtgtataatggattttaataaacagagagggagatataatatgtgtacgattatgcagaaagaagtgaatttctggcagtgatcgagcgtttaattaaatggaaactcaaagattaataacatagataagagaatcaattatgcatatcctgttgcaaaaatattataattatttacgcattgaacgacaactcagtccatatactctcataaattatcagcgtcagctggaaaaaattgtagtgattttacaacaaaacgatattcactcatggcaacaagttacgccaagtgttgttcgttttgtattagcacaaagtcgcaaagaaggattacatgaaagaagtttagcgttgcgtttatctgctttacgacaatttctaaattatttggttgtacaaggtgaattaaaagttaattcagccgttggtatttctgcacctaagcaaagtaaatatttaccgaaaaatatggatatggaacaggtgcaacaattattgactaatgaaagcaaagagcccatcgatcttcgtgataaagcgatgatggagttgatgtatagctcgggtttgcgtttatcagaattacaaagtttgaatttgaatagtattaatattcgctctcgtgaagtgcgtgtcatcgggaaaggaaataaagagcgaattttaccctttggacgttatgcttctcaagctatccaacaatggctgaaagtgcggttgttatttaatccgaaagatgaggcgttgtttgtcagtcaattaggcaatcgtatttctcatcgttccattcaaaaacgtatggaaacttggggtattcgacaaggcttaaacggtcatctcaacccacataaattacgccattcttttgctacccatatgctggaaaacagctcggatctacgtgcggtacaagaattattaggacatagtaatttatccacaacccagatttatacccacttggattttcaacacttggcacaagtttacgacaaagcacaccctcgagccaaacgtaaaaaatagttggaagcaggcaaattcaaacgaaatattaccgcacttgatggacgttcaagcacaatttgacaggttaccttgctcaacaacaatgccaacattattagcttgtgctatcgctttaggtttacttaattttatttttacccaagaaatattaaattttactcttaattgctctgcaacttcgtaagctactcgctcaattaacaaaaatgggcgagattgaacataattcaatataaactcactcacttccgcataatttaagcaatattttacatcatctgtttgtgcggctcggcgacaatcccacgccatttcaatatcaaaaatgagcttttgcttgatttgctgttcccaatcataaacaccaatttgagcaagtgcggtcaatccttcaataaatattttgtctgtcattataactccgatgaacgaaattccattaggcttatactatcaagtttatgtacaatagacgaacgaaaattttctgttccagcgatagggagttgatgatgagtttgtttgcgattatttatatgttattcacttatttgttagggtcaatttcgagtgatgttgtgatttgtcggtttaccgagcgaaacgatgctcgtgtaacaaactcaaatgtattacaaaaaggggggtatcggcttgttttggcagtttttctatgtgatgtcttaaagggtatgttgccagtttgggtaggctattatttagggttaacttactttgaattaggcatggtagcactcgccgcttgtttaggtcatatttttcctattttctttaaatttagtgggggaaaaggggtggcgaccgcatttggtgctatcgcccccatcgcttggggtgtcgccggctcaatgcttggtacttggcttttaatctttctctttagtggctatgttgcattaagtacggtcgtaactgcattaatattgcctttctatgtatggtggtttaaaccagaatttacttttcccgttgcattagtttgttgtttgttagtttatcgtcatcatgaaaatatccaacgtttatggcgaggacaagaagataaaatttggtctaaatttaaaaagtaacgttacatttgcttgcttaaaaatttaaatagaaatcttgggttaaggttttaaattctgtactgtattgattgttccgatcataaataaccaactgactttcctcacatttccgttcttctcggctaaaactaagtaataaacgctgtggagttttacctgctttagtgatgattttacattctctaatacaaaaaagaccgcactttttttgtaaactttttccttcttcaaatggcaaaatcaagtgaatttcacccgttaggtttaatagtttttcggcggcgtttagccaatccaagtggctttgtgttagggtatagcgagctagattgcgttgtttactggcacaatcaacaccttgcttaaaataaggtggattcgccgtaatgacatcaaatttatgctcacaatcttgtgcaaaaacaataatatcttgttgaaaaatcttgattttatttgcccaagggctttgttggatattgtcttttgcttgcaaataagccagctgatccaattcaactgcactaatttgacaatgttcagggctacgttgagccaacatcaacgcaatgagtcctgtacctgtacctaaatcaagcaacgtatttgcttgatttatatttgcccatgcacccagtaaaattccatcagtccccactttcattgcacattgatcttgattaatgtgaaattgtttaaacgtaaactcttgcttttttgccataaatatcctgaaaaatgaccgcactttaagaacaaagtgcggtataatttgccacaaattttttttgaataccaattctttaatgtggataaatatgacatcaacgcaatttgaagacttcgatcttgcccctcaattactaaaagcccttgcccaaaaaggctattctcgacccacagtcattcaacttgatgctattcctgccatcatggaagcgagagatgttttaggttctgcaccgacaggtacaggaaaaacggcagcttttttgttacccgctcttcagcatttgttagattatccacgtcgtaaacccggccctcctcgaattttagttcttacgccaacacgtgagctggctatgcaagttgctgaacaagcggaagagttggctcaatttactcatttaagtattgcgacgattactggtggtgtggcttatcaaaatcatggtgaagtgtttaataaaaaccaagatattgttgtcgctacaccgggacgcttactgcaatatattaaagaagaaaactttgattgtagagccgttgaaatactcatttttgacgaggcggatcgtatgttgcaaatggggtttggtcaatatgcagaagaaattgcggcagaaactcgttggcgtcggcaaacattgttgttttccgctacacttgaaggtgagttattaatggattttgcctctcgtttactgaaagatccggtgcaatttaatgcggagccaagtcgtcgtgaacgtaaaaaaattaatcaatggtattatcatgcagatagcaatgaacataaaattaaactccttgcacgttttattgaaaatgaacaagtaagtcgtggtattgtatttgttcgtcgtcgtgaaaacgtgcgtgaattgtctgaaattttacgcaaacgtggtattcgcagcacttatctagaaggtgaaatggcacaaactcagcgtactaaggctattgataaactgaaaaatgatgtggttactgtgttagttgctaccgatgttgcagctcgtggcattgatattgatgatgtcagtcatgtcatgaattttgatttaccttataacgccgatacttatttgcatcgtgtcggacgtaccgcaagagcaggcaaaaaaggtaccgcagtatcttttgttgaagcacatgactataaattattaggcaaaataaaacgttataccggagagttgctaaaacctcgtatcatagagggcttagaaccgagaaccaatccacccaaagatggtgagataaaaacggtgagtaaaaagcaaaagaaccgagccaaaactaagttggaagagaataaaaaagcagtgcagaagaaaaaacaaaaacttcgccataaagacataaaaaacattggcaaacgtcgtaagccaagtgcaaaagtcgctgaataaaccaacgatatatccccttgaattaaggggattatgttattgatagctcaaaggtaaaatttccaattcactttcatcaacaggtaatctaaatcgttgattttcttccaattggttactcataacgacttgcaaatataaaataccgttaagattgaccgcacttaaaatacatcctgttttacgccaagcatgttctaattgcatttcaatttcagtaccaatttctacaagtgcggcagttttggcttgcaataaatacatggcacgtttatttatccctcgatatttggctcgagctatagtttcttgtccaatataacaacctttttggaaagaaatagcttgttcgatttcttgtaaattcagtgcttgtggaataaattctccttgtccgattattgttaaaattggaaagccttgctgcatatccaagtaatcccaatattgtgtatcttgcgtatattcaaggctcattttttgttcccaacataaaatctggcgattacccaaatcaatgcgaatttgtggtgaaatagcaccgcactctttcagatcctgatcaagcatgcccacaatagtccaatttttttcactaaaagtcacttgagaaaaaaccgcatatttttttaattgagctaagccatgattgagtaaatcttggcggattaagagataaaattgttgttctgcatgacgaatcagacgaaaaagagaattgactttacctttcggatcgcaatgtgcggttaatgtggattgaccgattgccaactttgttacatcacaggttaattgtccttgtaaaaatttttcggcatcaacgccttctacataaattaaaccatattgcttaagattaattaacatttttgtccttattcaagattttggatttgttcacgcatttgttcaattaagacctttaattcaaccgctgatgaggtaatatcggcgttaatagatttagacgcaagcgtattactttcacgattaagttcttgcatcataaaatcaagtttacgcccgacagccccgcctttgtgcaaaatagcgtatgtttcttttacatgtaattgtagccgatccagctcttcagctatatcaatacgttgtgccaatagcaccatttcttgttcaatacgttgtgtatctgcttgtaattgaatttcatcaaaacgttgttgcaaacgatctcgttgccattgcaatatttccggcataaaagaccgcactttttgtgcctcaacggaaattgccataaggcgttgttcaattaatttttgaactttttctccctcacgagctcgtgttgcaataaactccacaagcaaatcatcaaaggcttgcaacaaatcttcgatgatactgtccaagtcctgttccggcgtttccactacaccggggtagcgtaaaatatccatcagattgatttcaccctctccggcttgtgcttttatatattgcaaagattgaataacctgtttggcgaacttttgattaagatttaagttgagtgcggtttgttttttagtgtcaatacgcaagctacattcgattttacctcgagccagtttttgccgtaatttttcacgcaaagtattctccaatcctcgaaattgctctggtaaacgaaaaaaggtttctaaataacgttgattgaccgagcgaatttcccatacggcatccccccattcttttttaatttcaacacgagcaaaggcagtcatactgtaaatcatatttttatatcctcacttttatattaatttaccggtgctattgtactgttaaatttcttttatgtcagtttgcatgataaaattgcaaaaattttttaacttcattcaaaggaatatgtcatgcgtccaaatgcgagagcaatcaatcaaccccgtccaataaaaattactcgtcattacactaaacatgctgaaggttcggtattagttgaattcggtgaaaccaaagttatttgtacagcgacggttgaagatagtgtaccacgttttttaaaagggcaaggaaaaggttgggttactgcagaatatggtatgcttccacgctcaacccatagccgtatgcaacgtgaagcggctaagggtaaacaaggcggtagaacgatggaaattcaacgtttaattgcacgctcattacgtgctatggtagatttggaagctttaggtgagcgtgcaatcacattggactgcgatgttattcaagcggatggcggtacgagaacagcatcaatcacgggggcttgtgtagctttaattgatgcaattaattttttgctgcaaaacggtacgttgacaactaatccgataaagggattagttgccgccatttccgttggtattgtcaacggtgaaacggtgtgtgatttagaatatgtggaagatagcattgccgaaacagatatgaatgtggtgatgatggaagatggacgtatgattgaagtacaaggaacagcagagggtgaaccgtttagccatgcagaacttcttaccctattagatttagccaaacaaggttgtgaacaactgtttgtggcacaacgtgttgcattagcggaataaagatagtttgtgcaagataaaaaatctacaatatacatttttacaatgtaagaatatcgcaatgaaaatggtgtggaaatacaggggttaaaatgaattttctcggaaaaataatcggttttatttttggttggcgttttggtggtttttttggtgctgttgtcggcctaattctaggacaccttgccgataagaaactgtatgaattaggaagtgtaaattccagcttttttaaaaataaactcactcgtcaatcgctctttatgcaaactacttttgccgtattaggacatttgaccaaagcaaagggtagggtgaccgaagatgatattgcccttgcaacaagcctaatgcagcaattaaatctggatgatgcaggcagacgtttagcacaagaagcatttaatcgtggtaagcaaactgattttcctctccgtcaagttattcgagagtttcgtttaggttgtggacaacgtgcggatttgttgcgtatctttttgagtattcaagtcaaagctgcttttatggataatgaattgcaaggtgcggaaaaaagtgtcttacaaattgtagcagaagagctagggttatctcgtttccaatttgagcaaatacttgcgatggaattagccgctagacactttagtcgtggcggtttttatcaacaaagtcgtacttaccaacagggaagttatcatcaatatcaagagcaaggacaatatcaaaacagctatcatcaatcaggcccaacgttagatgatgcttacaaagtgcttggtgtatcaggaaatgataatcaacaaactgtaaaacgtgcttatcgtcgtttaatgaatgaaaatcatcctgataagttggtttctaaaggattacctcctgaaatgttggaaatggcaaaagaaaaagcccaacaaattcaagcggcgtatgatttaatttgtaaatcgaagggttggaaataacttaatgcgagtttttttagcacctatgcaaggtgtgcttgatccttttgtacgtcaactattaacagaggttaatcaatatgatctctgtatttctgaatttgttagagtagttgatcagcgtcttcccaacaaagttttttatcgtttatgccctgaacttcaccatcagggctttactttgtctggtacgcctgttcgtgtacaacttttggggcaatatccgcaatggcttgctgaaaatgcccaaagagccgttgaattaggttctcagggcatagatttgaattgtggttgtccgtcgaaagctgtcaatggaagtaatggaggtgcttcattgttgaaacaaccggaactcatttaccaagcaacaaaagctattcgtcaagctgttccaatggaacagcctgttagcgtaaaagtgcggttgggttgggataatgttgatcaggtttttgaaattgctgatgcggtacagcaaggcggagcaacggaaataacgattcatggacgaactaaaagcgatggttatcgtgctgatcggattaattggtataaaattgctgaagtcagaaaaaaattacgaattccagttattgccaatggtgaaatttggcattggcaagatgggcaaaattgtttagccattactggttgccaagatttaatgatcggacgaggggctttaaatattcctaatttaagttatgtaataaaattcaatgcggaaaaattagattggcaacaaggtgttatgccgatgttgcataaatatgctcatgttgaaaatgaatttgacaaaggtttctatcatattgcaagaattaaacaatggctacaatacctgaaaaaagagtatcctcaagctggcacactttttgagcgaattaaaagctgtcaaagtgcggcggaattacggcataaaatacaataaaaatggcgtgtaatttacgttacacgccatttttcaaccaatgtatttattttacacgagaaacatattcacctgaacgggtatcaactttaatcacttcgccaatttgtacaaatagaggtactttcactaccgcacctgtacttaatgttgccggtttgcctccagttcccgctgtatcaccttttaagccgggatcggtttcaacaacttccaactcaacgaaattaggcggtgtaatcgttataggtgcaccattccataaggttacaatacaatctgcttgatccagcaaccatttttccgcatcacctaccgctttggcatcagcagagtattgttcaaaggtttcaggatgcataaaataccaaaacgcttcatctttataggagtaagtcaggtttaagtccattacatctgccgcttcaactgatgtaccagatttaaagttgacatccaatactttgcctgaaattaatttacggatacgggtgcgagtgaacgcttgccctttacccggtttaacaaattcattttcaataataacgcaaggctcaccgtcctgcataaattttagacctggtttaaaatcactggtagtatatgtagccatatcatcctcaaattaaaagagattgtttttaacaaatgcgtattctaacccaaaatagcataaatagagaagaagaaaattggactgattacctcgcaaaggcaatttccgatcctatagaattacttaattgtttagagttaccgattgaatcgtttcagtatgacattgcggcacgtcaattatttccattgcgtgttcctttcccatttgttaaaaaaatggaaaagggtaacccaaatgatccgctctttttacaagtgatggcttcacagcatgaatttttgccgatggcaggatttaccaaagatcctttggaagaacaacataacagtgttcccaatattttgcataaataccataaccggttgttattaatagtaaaaaacagttgtgccgtcaactgtcgttattgtttccgccgtcatttcccttatgcggaaaataaaggaaataaacaaagttgggtaaaatcgctggattatattgccgcacatgctgaaattgaagaagttattttttcggggggagatcctttgatggctaaagatcatgagttagcatggttaataaaagagcttgaaaatataccgcacttacataccttgcgtattcatactcgcttgccggttgttattccgcaacgcattactgatgaactttgtcggatattgagtgaaagtcgttttcaaaaagtcattgttactcatattaatcaccccaatgaaattgatgaaatattagcctgtgcaatgaaaaaattaaaacatgcgaatgtaaccttacttaatcaatctgtggtgttaaaaaatatcaacgataatgcacacattttaaaaaaattaagtgataaattattcagtatcggcattcttccgtattatttacatttattagataaagttgagggagcaagtcatttttatcttgatgatgaaagtgcggccgctatttataaagaattacaacgcattagttcgggctatctcgtaccgaaacttgctcgtgaaattgctcatgagccgaataaaacgttgtattcggcataggaaaaagaatgaagatcctttaaaatacataaaattttaccgcactttatgtgcttctttaaacataactttctgactcatcaagggactatcatgacagctgaacaaaataaaatcgacacttctggacaagcttctatacaaaaagaattggagcttgatctggatcctatggagccgatacttccgaaaaaaaatcttgcacctaaacaaactttattggaaaaagccaaacgtattttcaagagagcggataagcaaaatagagttgataaagcagaagtgagtacacataaagaagtaatatccgctagtgatgatgaacaacgtccaataatcacggaaacacaagagcaacaaataagccaagcaatagacccgactatatctgaagtgcctgttaagacacaaaaagaactgaaaaaaccggaaaattggactatgttaggtgtgttaccgcctaaatatcgccgtatttttattgcattattagttgtcgtcattattttattaattatttcttggttaaaaccggatgataatatagagcaatattttgaacaatcaacaggcaatagtattccgacacaatttcagcctttagatcattctcaaccggttgaaccgagcattttagagcaactgaagaatcctcaaccaaaaagtgaaaatatcacacagaatgatcaggaaaaaaatatacctgtacaagcgttgcaggtagaaaacgaaccccaaaatatagccataccgataaattcaacgcctagtaaggcggacagtccagtagtggaaacaagcaagcgaccaagtattaaagttgaggaagcaacatctcaacctatagcaccaatggaagaagtgaaaattgttgagaaaaatgagccaaataaaaaggcagaaaaacaggtgaaagcagagcagaaaggcgtgcctgttgttgatgcgaaaccggctaatgtgaataaagtaacaaattcacagaaaaccgctctacaaaaaaatgcacagactaaaacccttgttattccgcaaggaacatcactgatgcaagtattccgcaacaacaatttgaatattgccgatgtcaatgcaatgacgaaagcaaggggggtcggtaatacattaagtagtttcaaagcgggtgataaagtacaagtatccttaaataagcaagggcgtgtcaatgaattgcgtctatccaatggtgcgagattcatccgccaagccgatggaagttatcaatttaaaaaataatgatattaagcaaaacggcgtaattttcagttacgccgtttgattgtcaaactaacattttttctatttataaccgctctttttctccaccgaattcatccaacaaattttccgttaatttggcaagaatgcctgtcattaaaacaaaatccgcatcaaatcgttgtgcaaaatcttcttttgaaatatcgtcattttgttcacgaatttgatcggcaaattttaagcgttttaaactggcatcttcgttgagagtaaaacttaaatgttcttcccagttgagggataagtttgtgatatatttgccggaatttaacaatccgatcatttcttcactgtccaacacttgttgtttgcaacgaataacggcttgatcttggcttccttttaattccgcctcttccaatacagtcaaccattgaggtgagttttccttaacccaatttgtcatcaccaaacttggctcattagcaaatgcaagtggcacaacaggtaaagatcctaacgattttcttaataaagccaaacagtcttccgctcgtttagttgaagcggtatcaatgtaaataaggttattttccgtatcaatccacaacgcagtatgttggtttttactgaatgcacgaggcaataacgtagcgacaatatcatcttttaacgcttgtttttcgatttttttcagtttgcgattttctttttgctcaagttgttcaatccgttcttccagctcacgtttaatcacttgtgcaggcaaaatcttttcttctttgtgagcaactaacaagagttgttttccaacacaaaaatagagagattcactttcacgcaaaggattgtgccaaccgaaccggctcatgtctgattgttggcagggagaatatgcacattgttgtaactgtgattgtaaattttctaccgaccaatcaagggatttagttaaacggtaaattaaggcatttttaaaccaaaacattgttcttcctcaaggtttttcatgtaaaataagcactattgtaacttattcgagatgaaaatatgcaacataaattgattagctttattggtggaggaaatatggcacaagccattgttttggggttattaaaacaaggctatcctgcacattacattcgtgtttgtgatccgaaccaatctcgccgtgatttatttattgcacaaggtacgcaagtaagtagcaacaatgtcgaggcaatacaggatgcggatgtagttttacttgccgtgaaaccacaaattatggcggaagtttgtgtaccgttaagtgcggttgatttttcagataagttagtgatttccattgcggcggggatttctaccgtaagattgaccgcacttttacccagtgcgaaaaatattattcgtgttatgccaaatacgcctgcacttgtttcagcaggtatggcaggtttatttgcgacaccgcaggtttcggtaaacttaaaacagtttgcacaagatttattaagtgcgatgggggaaatttgttggcttgaacaagaacaagatatgcacgccgttactgccggttcaggaagtagtcccgcttatttctttttatttatggaagccatgcaacaggcattaattgaaatgaatttagatccgaaaactgctcgcttattagtgcaacaatcagcattaggtgcagcgaaaatggtgatcgaaaatccacaaatcgctttatcggagctaagggaagatgttacttcaaaagggggaacaacagcgtccgccttagcggtatttaatgaacaaaatgtgacgcaaataatcaaacaggcaatgctggcttgtgttaaacgttcacaagaaatggagagtttattttaaatgagagtttcaccattcagctggattgcaatttgtttgtttggctatttttttgcttacggcgtgtttgttccctattttcccgtgtggttaaaatcacagtcctataatgaaaccacaattgggttaattttagccggagcttacttttttcgtgcattgggcggaatttgggtttcctctttggttaaacgtccctcacaacttattagtggcttgcgttatttagcttgggcaacttgtgtcttgatgtttgtcgccggttttatggcaccgcacttttggctactttgtatcttaatcggactgttttcgatggcaagttccggaggattgccattaatggacacgctttctaccacttggcaacagcaacaaggtttagattacggtaaagcacgtatgatcggttctattgcctttgctgccggtgtggtgattttcggctatgtgatagaaatgattaatgcgacaaatattgtatggatgttgaccgcacttttattcgtttatgcaatagggcaaatggcaattccaacttatccgccactcgatcatattgaatctacacaacaagaaaataatgaaacggaaaaaacggattttagctttatacaattattaaaaaacaaagttacactacgtttgcttattgcgatttcgcttattcatggttctcatgctgcctattattcttacagcgttttatattggcaagaagaacttcatattccgcttcaagttattggggggctttgggcattaagtatcgtggcggaaattgtcctcttcttcttttcatcaaaatggtttcgacattggaaagtcagcacattattttatctttctgcgttaggtgcagtggtgcgttggggcggtttaagttttgccgacaatttgggtattgttatctttatccaacttttacatagtatcacttttgcgaccagtcattatgccattatccgctatatttccacacaacctcatcaagcgatggctaaattacagggcttatataacagtttttccgcctgtattgcagtcggtttattagcgggactttccagtcttatttatcccatctcaccgttttatacattcttaactatgatgttgattgcggcactggcgatccctattattccgagaaatatcaatgcctttcgtcaaagtatcatcactcgagtgaaatcatgaaagacaacgcattaattgatctttttttaaatgaactttggttagaaaaaggattatccgagaataccgtgcaatcttatcgcttggatctgaccgcactttcgcaatggctggagcctcaggggttgagtttagaaacccttgatgtggtagatttacaaacattcttaggcgagcgtttgacacaaggttataaagcaacaagtactgctagaatgttaagtgcattacgcaaactttttcaatatttgtatcgagaaaaataccgttcggatgatccaagtgcggtgttaagttcacctaaattaccgagccgtttgcctaaatatctgacggaacaacaagtaacggacttactcaacacacccaatacagaaattccgttggaattaagagataaggcaatgttggaaatgttgtatgcaaccggattacgtgtaacggaattggtgagtttaagtcttgatagtatcaatatcaatcagggtgttgtgcgagttatcgggaaagggaagaaagaacgtattgtgccgatgggagaggaagcaaactattggcttcgtcaatttatcctatatggcagatcctttctcttggcagggcagagttccgatgttgtttttccaagccgtcggggaactcaaatgacacgccaaacgttttggcatagggtaaaatattatgcaatattggctgaaattgatacttctgcactttctccccacgtcttacgtcatgcttttgctacgcatttagttaatcatggtgccgatttgcgtgtggtacaaatgttactgggacatagcgatttgtccactacacaaatttatacacatgtggctaaagagcggttaaaaattttacatgaaagatttcatccaagaggataaatttttttatatttttttgtacacctgtatcgtataatgctccgttagtttaaaaagacaaagttaaactatttaaaaaattcatttctttgatacataaggagtttttatgaaatacaaactatctttagcaattctgtcaatactgcccgcactttcccatgcgggggggggtaatttcaacttttacggcaaagcaggaatcgatttaacctctcgttttgaaacaatggttctcagaacagaacaaaataattacgtcccgagtattcctgcaagttcaagacaaaataccttctcgccaagtatcttttttgaaaccacctacactattttaccgcaaacagaaatcggtctaggattaggctatatcaaacgcaaaggcttcgatcattctgccagttggcattttaataaggatatacaaaaaaaaacgtgggcacaaacatctggttttacagacatcgaacaatatagaatttaccgttattcttccctaccaatttatctcatcttgaaacagaattatgcgtttaatgcaaacagcaaattttatctaaaagggaatataggttattcaatcaataaaatgcctaatacaaagtatgctcattattcaaatgagacaagcctaaaaattcagcaaacacaaattggcgatcctatttataaaatgaaagcaaaaaacgggctgtatttagggttgggtatcgggattgaatataaatctttcttagcggaaattggttattaccatacccatgcaactgtcagttacaaaaacaaaaatacccaatatccacaatattcctacaacaacgatgccatacgtttaacccttggggtgaaattctagaaaatgaaaagcgactaactgcggttagttagtcgcttttatagaaaatttttatatttttttgtacacctgtatcgtataatgctccgttagtttaaaaagacaaagttaaactattttaaaaaatttatttctttgatacataaggagtttttatgaaatacaaactatctttagtgcttttgtcaatactgcccgcactttcccatgcgggggggggtaatttcaacttttacggcaaagcgggaatcgatttaacctctcgttttgaaaccatgcaactcagaacatatctgaacaatgacgtaccgagcattccagccagctcaagacaaaacaccttttcaccaagtatcttttttgaaaccacttacactattttaccgcaaacggaaatcggtctaggattaggctatatcaaacgaaaaggcttcgatcattctgccagttggcatgtacatactgatggagaatgggtgataagagcagacaatactgctgttgagtactataaaataaatcgctattcttccctgccgatttattttacgctaaaacaaaattatgcctttaatgcaaacagcaaattttatctaaaaggggatataggttattcaattaataaaattgctgacaccaaatataagaaatatacagatattacaaataaatttgagttacaaggtgaaaacctacgtaaaatgaaagcaagaaacgggctttatttaggtttagccattggacttgaatataaatcgttcttagcagaaatcgggtattatcatactcacgctgcggttaattataaaactaaaccttacaaaagcaaagcagaaggctactatgcttggcattcttacaacaacgatgctatacgtttaacccttgggtttaaattctaaaaaataaaaacgtgattaattgatctgcacctaaaagttggactaaacaaccaacgattagtgtgcagatttttatgacaaaagataacccatctttcaaatagcaagccatcgttgagttttatttatcaaaaaagcagtgagtaatcactgcttttttatggtcgtttaactaggttaccaagcccagccgatacccacaccgccaccgaagtcgccgacagagttgctatttccgtgtaatttcaacagaaccttaccgttatcactcacacgagaatagcctaaagcgaccgcactttgacctttatacgtaccggcagagactgaaagcactgatttccccggaatcgaaatcgtaggcaatgccgccgccgcattcgaaccggcaattcctgctcgagattctttactaaacgcatcaaacctattttcaagctggttgaattttttgtcagtatgtgtttgtaaggcatcgacatatcctttgttaaccacggcattcggtgaagagttcggcgttaaatccggcactctgatttctcctttcaccccgtcaatttcaatacgttgaccttgcgggttggtcaaggttaatccgcttggcgtcaaagtcgcactgtgcttaccgacagtcaatctcacgccgtctaccccatattgtgccgatttgccgtctttatgagttacccgtaatccgttgccgtcaagacgggatttattcccctctgcggtttctttggtttcaaaagaggtcatatttttcaacttatcggacagtttgacttccagtcccgtctcggaggcgtccactttaatattgcccgccgccgtggtcgcactgttaaactcgccctcgcctttgatggtcaatttctcgcctaaatttttatggacaagcacgccgtcgttgccctcaaaatttaagcccgcttgacctaaagctttcacgtcttgaagattggcagcacgcttcacatcaatgctggaatcatctgacaaaaacttattgactgcgtcatcttttgtggctaatgcggtttgataggcgtcttgcttcgcttttaatatgccttgtgccgattcaacctcttttttcgccttatccaatttcgagttaatgtcggctaatgttgatttttcgccctcgatcttagctttggctttctctttcgccgctttttcctccggtgtagtttccggcatgaaagacaatgcggtttcaagagcgtcaatggcgtcctgtttcgcctcttttgctgtttgtagcgtcaacatatcgtctacttttttcgccaccgcctgtgcttcggttttcactgcttcgcctgcctttttcacgttttcagcctgctctttcgctttgtcggcatcaatacccaaaccgcttgctatgttgctgataccgataggggttgaagtcggctcggctttgatcacgacttgttttgcttcatcgccagaaagttcttgatcaggttttccgtctttcaattttttgaacttaccactagcatctttaactactttttggccatttaaataaaaatcgaatggacggttattgttcagagctttaacctgttcatcgacatagtttttattagtagccatatcaccagtagacttatcgtctagatctttcaagcctttgatagattttatattttctagatcttcttttgtgccaatcgttatcaccgctgtcgtattcgatggctcgcttgtactacttgctgtgctagctgtcgccatacttgaagcagtagctgatgaagctgtattgctcgcatcacttcccccgccaacgctattacctccgttatttgcacttggttgtgtagccccctcttttttctctaaagccaatgtaatattttgaccattcgtaaatttcaaggtatcgtcacgaccgatttgataggtcttaccatcaccattagccacattaaatttaaagctacttaacgcttgttcaaggtagcctttggtgatgagttcttttttagaatcttcagtcagtgtatttctatcataattttgattttcagatagacttacacttttgaatattggactatctttaaacccaatttctattttagcgttaccactttcataactatattgagtgattaaattatctcctttatagtccccaatatttattgtagatgtactcggttgtggaggtgttgttgctccatttgatgtgccggctaatttaacaatagatatagttgagcctagttttatgattttatctttatcatcattggttggaatactatctgctacatatttataacctctttcatccacatattttttatttgcagcgtcaaaatcatgttttggatctccaacaaatactattcttcttctatttgtcgcattaccaacagataaagcattgtttacagctattgatctatctcctaatactattgcattatttatttcttcatctgctttgatatgagatcctaacaatatattttttcttccatttacttcgttatttgaccctattacatacgtttcgctggaatcaaaacctatttgattttcatcaccaaatacaaatgaaaaactaccatttactttattttctctacctacagatattgaactacgtcctaatacatcagaatcttgtcctatagaaattgctcctttattttttgcggacgaattatagcctaatgctattgctccctcattttgcgataccgcattatgtcctatagaaattgaccctgttcctattgcttgtgtttttgcagaatcagaaagtttaacggatttatcccctgtgcctttcagatagtcgactaaggctttggcttgtactaattcgcttgtaccctctgtttcatcttctttaagattgattttatcaatgccgatattagaaccaaaaatcgctttatctttaacatttgcaccatctatttctaaataatactcttctaaatcccctactagagtatctctttgagtatattttttaagctcttccgccacagctttagatgttacaactttgtcactatctgggttaaaagtcgtttctttatttaacgttaacgtaagtgctttttctgtagcacttgctgtagccattatatctacatcggttccatcacctttgattgtgatagtctctccaagtgcaacgttggctgtaccgctatttcctgcaaatgttaatcctttaccaataatcgccttagccacatcagataagtctttaacgtttatggcattactttgaatagtatctatagaacttccagttaatacattttcaatattagttgctacattatttgcagtcgtatctcctaaaccacttgcaacacctgaaattttaactttatcactgtttgattttgtgaatgttaatgtcgctccactttcagggcttaactcaatttgctttttaccattacttgtaattttaagacttccagcatcagttcctgcagtgatggtcgcctcattctcttttaattcaagttttgatttaccatgagctaattctacagttgctttatcagcattaagtgtcaatttagattgactgtctttactactaatttcagaaacgccactgaatttatcttctgttaatgttacagttttacctgaatttccggctgtgaaaacgatagattttccacttccattagttccattgtttaatgaaattttcacatcgtcaccattagcaactgattttatgccggttaaagcatcttttaatgtgatacttactgtttgcttattcttatcaactttagtgtcaatatttttgctatctcctgcaattgttaattcattatgctctttatctaatgtatatacttctttattatccttactattatcacccttaaccgtaaaattagcggcgactttttctagtcttttgtctaaatattttttgttgacagcatagttatcataagtatttttcttaggattagctggctcgtcttcgggaatatcattttcaattaatacatttttaaaagtaggtgattcttttattcctattaataattgcttactatcttttagatatgctgttttaatattatcaggaacgtatcctccttcttgagtagtagttggtttatctacagctcccgctttaatgattaatttatcacctaaataatgcgttcctttttcagtatcgccatctccactgccaaaaataaagcccttattaattttatctatatttgcctctattgccgctttaaatgttttttcttcttttagtatctgtccattttgttcagttccatttttaaatttattaaattgtgattttttaaatgtaaatttaccgttatcaacttccgcacctaatacatttgttgcaaagttctttaattgtaaaaagttaacagcatgattgtcattcgttggtgcttcagtaattgttacactcttaaattcaggatcgtcttttaagccgatagtgaatttagcaacggaattgtttgttttgccttgttcaaatttcgtttctaaatttttaccgacatattttgttttactgtttgattcaatatctccatttacaatttcaatcgtagatcctaaataaaacggtgtatctttatttggatggtcaggagtaccatcactaaacttatacccagagttaatcgctgcaatggtttccgttaaagcagccttaaaggtatcttgtgatcccttgtctccagcttcaacataattcacagcagtaaaatcatgttttttaaattttgtttgactatctttttgatattctaatcccaatgcctcttttgcactatttaactgtgctcccgtaatcgcctgatcggaagtcgctgaaatttcgccatcagccaaatgtccaaattttattgtttcccctatgtcagcagttgtttttccatcagcaaatgtttgagttttttcatcaaatcctttagcaccaacgaagactttgttcttgtcaattttgcctaatttttttaaaggttcgccatttcttgtatctactctataaaattcaccgtcatctgatgctttcattaatttaactattttgttattgttatccactgtataataaacaaccaacccctctttttttacatattctaatgtttttagctgaccaacagtcgccacatcagaatccaacgctcccggtgcaacatttattattcttctaagtcccactgcctctgtgtttgtaccttcgctaaccttccaaccaccaacagatatcaccccataagaggcatcattttttatttcgtaagttgaacccgcagctttataagcatctaatttagaagctggttctcccgataatttaggcgtaaatttgtcgcttgcatctgctttgttatcataaaaataattagttgttgatttatatcctaatgcaacagaattagacaaattggcttcagcttcattacctaatgccaacgcacctgtagcatctctacctacacctgcttctataccaagtgcgatacctttttccgcttgagattgtgctttataaccgatagcaactgaatattgtttacctgaatacgtattattccctaacgcaattgaggcttgaccaatggcacgtgtaaaacttcctattgcaaaggcatctttcccttttgcaaatgaaaatcttccgattgcaatcgcactatcttctttggcgtaagcgtatcgtccaattgttagcgtattgtctcctaatgcgaccgaatacgatcctatcgctattccaccttgattatatccgagtgaatctcttgattgtttcgcttttaattcttccgttccctcttgtttggtcgttttaggtttaattaaacgagaataagtttgtatatctgctgtatttcctttttcatataattcttcaaaatcaaattttgtaccatatgaatttttcttatccgttaaagtaaagccattattattttgaagtccatcattattgaaattatcatccatctctatatttgctaatgcataatttccaattgccaatgaacctctaccgcccgcatacgaatcggaaccgtataccatagcaccatcattaattgcttgtacattagtacctaccccaaccgttctatctgcatacacatacgatttgtttccaagaactaatgattctttaccaaatgcgattgtatctgaaccaattgctgttgaataatctttaaaggcaatggcaaacgttccgattgcagtcgtataatcaccgtatgcaatacttcttgccccaaccgctattgcatttttccccctagcccatgtgtgagtttttctattatcgtatttaactccatttaaatttttttctttctctattttgtttctactgtccttatctaaatatttttcataggcgacatttactttagaatcatattcttgttttcgtagataatcgtctttcttttttattttttcaatttcatctctttctgtaactttatcatataaatgaccattttttttataaaaaacctcttcaccattatcatttttgataagataataactactccatgttttaccatcatctcttacaaaataatctccatttaatactagagcattaccatcttttcctactaactcccctttgccattaacatattcattttttccgacaccattaatacctaataaaaatctaaaatcaactgccggatattcctctgtatagttaaaattttgtgcattatctagaaacaatctaaagatgtcttttggtagttttttttgttttgcatctgcatttccgataccgtctgatccaatcgcaattgaagaatctccccaagcaactgtatcattccctaatgatgtcgcccctgctcctctcgcaaaggttctatatccaaccgctgttccttgtgcgttagcattatcaatatttttatctttagtgttttctccaacaatcgctttatatcctattgaggttgcaccaattccaccacccacagcacgagaacctataatgactgcatatttggcgtgttgattttcaatactagattcagcacctgctttatttgatttgtctgctaataatattagttcttgatgtttttctttaatgtttttatccgctccgtcataccaaatacttgtattgtagttagatttaccgtattcgctggatgtattattatctatccacacatctgctccatacgctacactcgacacccccgacatcgccaacgccagcggcaggaccttaaacgcccctaacacaccgccgaaaaacccaccgcactttggcttttcccccgaactgctcgctatttggcgattgcttgccaactcggaaacggctttacattgacctgttgttacatcgtattttgttttgaagattttgttcatatatctattctctttaaaaatggatttttaaattaatgatttctttcgttgattgattgtttagtaaactttgtaggaattggttataaacctaaacaggaaatgccttgctttttaaggcacagcaaaaaaaggcgaatgatatcttcgctaaggattttaaaaggggaaatttgggtatgacgagaagttaaaaactttttaaaatttattttgcaaggtttataaaaaggcgttagcctaggctgtaggctgtaggctgtaggctgtaggctgtcatttttctattctatttttgtttgtcaagtaaaaatccggattattctatctcaaaatttttatggaaaaaacaattttcttacgtttttattctaattcagagggtgatttttaattacgttgtttgatgtcaaagcgaaatttgatgaaaatgaccgcacttttgggcgtaacaaaaatccctattggatctgatttcaatagggatttgttgtttttaaattatggcaggaatactattttttccaattatattcaggattgataatatcttctatttcatgccaataagcagttagtacgacattgccataagcataagcccgaagtgcatagggcggataaacaaagtttattccttcattattgaagtaaaattgttctgaaatgttgaaatcttcttttgtgatcataccaatatagtcatcattcgcttcttccatcagattggtataaaagttccaaagcacttcttttagcttgctttgttggtcttgcttaacgatgtcgtttagttcaagtattttctttttatgactgtcaatattctgaaatagggttacatttatgccgtgagcaccgccggtataagtatcaatatcgttactgaacgtaatgatattattgcgttgccctagataatttgacgttagatggaatgatgcacctaatacacggtcttcttttgcactttgaacgaattcatcatgaatttgttgaaatttttgtacaagatcttgttttgtcggcgtgtcttttttcatgctatcttcaccgcccactaaggtataagcatgtttgagcaataactgatcaagccattttataccggtttcggataactcaccacgaacttcaatttgtgcattgtcagtagtatattcatcggaatgcgggtaatttacggtttttacttgatcaaagataacatttttcttgacttgtaaagttggaacgtcttgttcctgacaagctgccaatagaacagttgtcataagagagaagaataaaaagatttttttcatatgattgccaaagtttagtggagtaagaaagtctttattataagttggcagagtatgaatgtaaatttttcttttgggtaagaataaatcgatatattaagtcgctattcttccgtataatacgggttttatttagatagaacgcaaggatattttatgaagcaaactactcaatcgatgaatatagtcgatatgttgatcgttacagtgatcttttttggtatgccgatttatatttctctgtcgcaatttttcttattgcaagaaggtgcggtcgcaattacagacacgttgacatttacggatcaggataatatttgggcaattttgatagaacttatctcattagcgattgctgcggtgtatttaaagctaagacgctttgattttacgcagcttaccttttcttttaacgctaaagcgattgtgctgaccgcagggataattttgattgccggcagtctcagcgaactttatttctatttggcagctccctttcaagatgccggtgcatatctcacttcggctgaggttgcacctacagatacaacatcgaccttatctttttacctcgtcctcttttcattgctcaacggtttttttgaagaagtcttttttctcggcttgatatttgcagtgaataaaaaagccttgccttatgcgattgtgttcagcttggtcatccgttttttgtttcatacctatcaaggtatgttttatgcagtaaacgtattgttattcggtatcgtattgctaatacttcgctctaaaattaaaaatttattaccgtttacgttagcacatgcgttctttgatgtgtttggactggggttgttacccattattgatattgtcgaaaaaattatcaaataaaaaggcgtattaaatacgcctaaataaacaatcggataaccgttagaaacggtagttaagatttaagccgtacaaattggcacgtgccgttgattgataatccgcacttatattaacgagtttaatctcttttccaatattttgtgtttcgctaaattgctgttttttacctcgtaaatgagcaaaacctacgtcaacagaaagatttggcgtgaagttataggttgcccccaagctataccaagtgcggtcggtatcggggattgaagcacttgggtggtcggctgactcatcataagcaatacctgcacgcagggttaatttatcattcacattataagtcgcccctagagctacacgtgaactgtcatgaaatttttcatctttatggaaagcgaccttgccgttatcataagtggcatgtaaactttgtaaacggctccatttagtatatttatagctgtagtgcatggcgaatttttccgttaattggtggaaaccggaaatttcgaaataatccggcaaatgtagcgttaacccacctttctctttaacaggactaattcttcttggtttaagttgataactcaacgcatcatcatctttaaaattaatatctactttagaatgataggcaataccgatacggttaccttgattaaattcatagactgccccgatattccaaccaaatccccatgcattattatcttgtaattgtattatgctagtatccgaattaacttttatttgagctaatgcagcaagcagttgttgtgatgacggatccaatctgattataaaaccccctggttgtcctcctggtgttgatatttgcttaacagtaccaagtgcttctttcaaaatacctgcatgacgctcaattttcgctttggcataaaccgcattcaacccagcaccgatgcttaatcctttgctgatacggtatgaaccgcttaaatttaagttaatggaattcagtgcggtggttccacccaaaacaccggcatcataatcctttttatatttactttgtaacccaaagttcacattcatgcccgcaccgacagcaaatttatcattaataggtgcgacgaagtacatattgggaataactgcacttggcacaatgtttttctgatccccttttccagtttcaattccgtgaaataaccccgcattaaccttaacctcaccatttatattaattctagattgaacgtataccccccccattgagaattgtttcgttttaaacaaactcattaacgctgggttggttgccacaactgcggcattatcagcaattgccgcttcacccgcataagctcgtcctaaaccggaactggacacctcagcaatttggaacgccgccgcattaacgtaacttgccgataatgccaatgctgaagcaatgaaagatttagtaaaaagtgattgtttattgctattcattttttatttaatacctctatatatggtgaagttaaatttcccgaattctaaagtaagagtagtatcgggacaaatgaatttacagatttgttcagtggtcataccaggcggaaatcttttatttattaaagtttataagaagaatttagctgtgtcagacaataaatcggtgagtgctagttcctcattttgtagaatgttaaaaactttttattgtgttttttgggggaagttataaagattgggtaaaaaattgtataattctttataaataacgcaatataatgatttaatgctaaggaaataggaatgacattgtacaaaatattggtgaatagtatcgctatgatttgttttagcgtttcccttgtagcacaagcaaaaataacggtttttgccgctgcttctatggtaaatgtgttagaagaaattaaatctgaatacatcaaagtaaatcctcagcaggaaattgatttttcctttgcttcttcttctgtcttagcacggcaaattagtcagggagcacctgcacagttgtttatttctgcggatcaaaaatggatggattttttagcggaaaagggggcaattgtgacagaaagtcgtcgtgatttggttggtaacagattggtgatgattgcacctcagaatagtttgattacctctgttgatttgcctaacgctcaatggcattctcatttgaataatacttatcttgcagtaggtgatcctgagcatgtaccggcaggaaaatatgcaaaagcggcatttatctttttggggcaatggaatgatttagaaactaaattagctcgtgcaaataatgtgcgtgcagctttagcattagttgaaagaggggaaagtccgttgggtgtcgtttatgcaacagatgcggcagcaagtaaaaaggtcaaaatagtggcgatttttcctgaaaatacgcaccctgcgattgaatatcctatcgctattgtgaacgggcaagataatgaagaaagccgcaagtttttggcttatttgcggtcagaaagtgcggtcaaaatttttcaacaattcggtttttcagtgaaataatttttatgttagatgtgatgatcgattatctacgtttatctcaatctgaaatcaatgcaatctctttgagtgttagagtggcattggtttcaatttcggtgagcttaccttttgctattgctgtcgcatggttgcttgcacgcaaagatttttggggtaagtcgattattaacggtcttattcatttaccgcttgttttacctcccgttgtaattgggtatttattattaattgctatggggcgtaacggtattattggtcgctatttactacagtggtttgattttagttttggctttagttggtacggtgcggcgttagcttctggaatcgttgcatttccgttgcaggttcgtgctattcgtttggcaattgaaaatattgattttcggctggaacaggcagcacaaacgttaggtgcttcttcattgcggatattttttactattacgttaccgctttcattaccggggattttatcaggaatgattttaggttttgcacgatctttaggtgaatttggtgcaaccattacttttgtatctaatattcctcaagtgacccaaactattccgctggcgatgttttcttttattgaaacaccgggtgcggaatattcggcatttagactttgtgttatcgccattattattgcattgatctctttatcaatttctgaatggctggcgaaacgaatgcaacaaaaattggggtaaagatacttgtaattataagcctgtgccgagtgatactttagcggtaatttttgattatttattttacaatcgttcatcatttcctatatgaggctttatcgtgtcgttatttctatgtgctgaagaaagattagtgcaatgtgcaacttctttaattgaacagtttcctgagcaatacaacactacactttttcaacaaattcaaaaagataaacataatcaaaaaacgcaactcgggcaattaggttatggattatgtttatcagattttgtgtttgaaactttgcaaaaacaaccgcactttctcaaacaatgttggcatcagctccctactttagctgattgcgatcgatatttcgttcgcttacaggaaatactgataaataccgaaacggaagaacaactgtaccgcaagttacgtctatttcgtcatcgtgagatggcaaaacttagcctttgtcaaagtttaaatttagctacagtagacgaaatttttattcggctttctcaattagctgaaagtttgatcattgccgcaagagattggctgtatgaaaaaatttgcacagaattggggacgccaacggatacacaaggcaatcctcaacaattatatattttgggtatgggtaaattgggtggatgtgagttgaatttttcttcagatgttgatttgattttcacttatccgacaaatcagggggaaacacggggaggacggcgtagtattgaaaatggtgtatttttcacaagattgggacaacgcttaattcgtgctttagatgaatatactgttgacggttttgtatatagaacagatatgcgtttacgcccttttggtgaaagcggtgcattggcattaagttttaatgcgatggagcaatattatcaagatcaaggtcgagattgggaacgctatgctatgataaaagctcggattctgggagcaaatatgcaagatccgaatgtaaaaatattacagcaattattacgctcttttgtttatcgccgctatattgattttagtgtgattcaatctttacgtgatatgaaaaataaaattgccggtgaggttcgccgtcgaggattgttggacaatataaaattgggtgctggcggtattcgagaaattgaatttattgtgcaggtttttcagcttattcgtggcggacgtgaaatcattttacaacaaccatcgctgcttcatcttttacctgcactggaaaaattgggtttaattgataccgagcaaagcacaaatttatatcatgcctatttatttttacgcagagtggaaaatattttacaagctattgatgataaacaaacgcaaacgttgccaagtgcggatatcgatcgtgaacgtttacttcttgctacaaaaaattttacctattttccgatatcgacggaaaatgcaggaaaagaaaccgcacttgctcaatatcctattgaaaattggcaacaatttttacaggtattgcatgaacatcagcaaaaagtgcggttcgtttttcgaaatttaattggcgaagatgacgatgaggaagaaaaaaatattgctgatgatctgtggcacgactttctcaatgcggacattaatgagcaagaaattaaagtcatattgcaggaaaatcaaatagatgagcaatattttgatgaaattattgaaaaattgacacagtttaaactggatttatctcgtcgatcagtgggagaacgtggtcgcagagtattaacgcaattaatgccaatgttgttccgtcaagtatttcgatacaaaaattctcagcaacttttacctagagtcttgaaaattctggataaaattatcacgcgtactacttatcttgaattattggtagaaaatccacaagccttaactcagcttcttaaattatgtgcacaatcaaaaatgattgctgaacaagttgcaaaatatcccattttacttgatgaattattagatcctaatgcactgttaaatcctacggattttcatcaatattcatctgaattacgccgctatttacttcgtttaccggcagacgatgaagaacaaattattaatgggttacgccaatttaaacaaaccgccttattacgtgttgcggcagcggatattttaggggcattacctgttatgaacgttagtgatcaccttacctatttagccgaagcaattatcgaaaatgttgtcaacctcgcttggcaacaagtcagtctaagatttggtacacctgaatatttgaaggaaaatcaaaaagggtttttggttattggttacggtaaattgggcggcattgagcttggttataaatcagacttggatcttgtttttctctatgacggaagtcaaacaggacaaactatcggcggtaaaaaatccattgatagcaatcagttttatctgaaattggtacaaaaaataattagtatttttagtatgaatactagtgcaggaatactttacgacatagatattcgtttacgtcctgctggtgattcagggttattggggtgttccttaaatgcctttgaaaattaccaactgaatgaagcgtggacttgggaaaaacaggctttagttcgttgtagggcggtatacggcgatattgatttatgtgaacgctttgaaaaaattcgttgtaatgtgctttcagctccaagaaatgtggaacagctgaagcaagatatacgagagatgcgtcaaaaaatgtatcatcatctctctaaacataaaacggacgaatttaatattaagactgatttgggcggaattaccgatattgagtttattgcacaatatttggttttagcttatgctccccaacattcagcattaacacgttggtctgataatgtcaggatatttgactgtatggctgaaagtgcggtgatttcacaagaagtttccacaaagctaaaaaaatgctatgtaaatttacgaaaccaaattcatcatttaaatttattaggtcaagaaccgattattaatgcacaactatttagcaaggaaagaacctttattctcaatacatggaaaagtttattggaatgaatgaacttataattgccctaaaatcagcatatgataagaaattatttatcatttgtattttctttgttatgctatgcagacctttaacttacattaacaaatgagaaataaacgatgaaattaaataaatcacttttggtcggcacattagttgcctcaactgtattattagcagcttgtaatgaaaaaaataaagcggaaacaacgccaactgaaccagttacagttgcagaaactcaagctcaacctgacgttcaaggaaaaactgaaacaacttcatctgaatcaaccgcagttgaaaacacacaacctgaatctcaagaaaaagttgtttcagaaaaaagtgagacagctgaacaagaaattcttaatcagtttaacaatacagttacgatccaattggtggggtatcagagtgaaaaaatagagggtgaagatactttatctttcgtttataacgttaagaataaaggtgataaagcaatcaaagaacttcagtggtataaccttattttctttgattcgactctggtagagcctctttcaatagcctattcttttgaggatacgcttgctccagaaggcgagggcgaaataaaattaacaaaattagctaaaacttatgctgaagagattcgtgcagatatactaaaaccggaagctaatcttcaatttagcccaataattgcaggtcgaattatttttgaagacggtacgcaattagttgtaactacagatgaagagcttactcaatctttacagcaaattttaacgcaataatttttaaaaataattattcaatgtgctagttatctatccgatcttacaagctataaaatccataaatagctacaaaaagttatcaataagattttatagattggtaagatcggttatgtttccgcattgaaatctactgcccattattggcgaaaccgaaagaaattcgtcgtaaaaagcgtgcagagcaacaagaaaaagaagtgtgaagaaaaaaagctgagaatttgctaaaaatcagctcaacaaaccgcactttaataataaaaatttctgcgagaaatcatgtaaaaaaaataacaccctcttaacaagaagagggtgaataatcaatttaccattggtaccctatagaaactgaacctgccattttgccttgagaatttctatttccttgaaatttaagcataatcttaccgttatcactcatacgagaataaccaatcgccattgcgttttctccgccataacctgctgcagaaatggctaacatagatttacccggcatagagactgatgtcaaccctgccgccgcatttgcccccgcaattcctgcacgtaaatttcggtcagtattattcaattgtgtacgcaattcattatttctaccgtccacatagtttttatttaccaccgcacttccagtggttgttggtttaatatccggcacggtaataataccttgtttaccatcaatcttaatttcaccacccacacctttaacagttaagccttttgcaccataggtagcagtagcagtaccaatcttatctgttacagttaagccatcgctatttaacgtcgatttcttaccgctctcctctttggtttcaaaagctttcatatttttcaaggtatccgacagttttatttctaaaccatcattagttttattggtttctaccttgatattgccagcggcactactaaatgaacttgtagtttgaccgttttgagtttcctcttcccctttaataattaaggtatcgctcagttttctatgaacagtcttatccttaccactctcattccctgcaaaactcaatcctgcttgtgcaaccgcttttaaatcagcgagattggcggctttgtgtagttcatcttttgtcatttgttgcccttgctgaccgttcataccctcagcaactaattttttcactagctcaagcgttttatcttgtcccattggttgatcttgagtgccattatcaagccctaaaccggatttgaggttattgatggcaacaggtgggtgagaagtactaccatttgtgtcttttccgcctaaagtgatagtatttttcgcttcactatcatatttcactgccactttatccgcttctgcctgtttatcggcgatggtttggattttgtttttcacaaattttttcaccgcaccggcagtcgtgagttttttgtcttcagtatcagcatcctctttaatatcttcagtcgcttcaatcttaaaggaaatggtgcctgtattcgcatcaatactcggtttgatatagtcatcaccttttaacttaattgtcgcaccaagctgacgtgtcattttgtttgctgtggtactaccagcctgatctgtagacgttgtagtactaccagcgtccacttcgaagattaaacctttgttaatggtttcgatgtttttatcaatagcttctttgaaagtagttgctgctttgacagtatcatcttttccgtctttatctttcaatttagcaaaagttgattgtttaaacgtttttgtcttgtcatcaacctcagcccctaaaatatctgtccctaattttccaaagacttcaatcacaccataaagctgtccgccattaatcgcatcagttgaaccgggcatcacgctacctgctgcaacgtgagtaataatgcgttctgctcctgtattgcccacactgacgaccgagttccactgcccattcttagaagtacctgcatctttccagctgaatttcaaactgtttttacccactccaaattcagcactttcaagtgcgtttttcttcgtttccaatttagaatttttccccaaggcgaaagaactatcatcgtccttgtcgctaagttgaataattcccaatttatctgttactttttttgccaatttaagcgtaacgttttgtttgccctgttcaactttcgtttcaatctcatcttttgtgcctaatacttgcaaggcttgcgatctgagtttaaccgcaccttgaggatttccgcttgcagatggcgtacctgtgggctgtggtggttgcggttgaggttgtgcttgtgccgtgttggaattatccgcttcaatttttagcgttaatgaatccaattgagttttcaagtaatttttaaccgcacttacggtaaccagtttatcgccattcgggtctgttgtactacctgaaccccccatgctttgaccattcgtatcaatcgaattagccacattaagtttaaaggtgattttgcctacattgctaccgccactgccattttcagtcgccaacgtgaggtatgagtcgcctttaaacgttaaggtttcacccagtttacgagtgacaggagtttttccgttttgtgctgatggttgagttgtacttccatcttccaccgcaaacttcaagcctttttccacaagggctttggcgatgtcggacaagtctttcacattgacagcgttgttgaaaatgttactgccattactaccaagatttccattgaggacattttcaatattgctagttccgctacttccgccattgctatttacccctaaaccacttccaagtttagtgatttgtttattacctaaatctaagccgtctttgccaaaggtaaatgtgccactgtcagcggtgattttgaccgttggactagttgggctaccactaccattcgtaaattcaatttttgcaaccgcacttccgttacttccgctaatcgtgctaatgcctttcaaatccttattcaaagcgatttctaatgtgtctttgcttgtttttgtgaaaatattttgatgggtatttggtgcaccattttgccccgcacttgtcgctgggcttgaagcatcgcctttcgcccctttaatgttcaaggttgaaccgagatagagttgttgctcgctgttgcttccaccacttccgttagtatcacctttaaacttcaagccctcattgagtttggcgatgtttttatcaatcgcgtctttgaaagtacttggtgttttactgttactatcacttccacttgcatctttcaattttgcaaaagttggcattttaaaaccgtcaccatcgctatctgctttttttgcacccaatatactaatgcctaaatgaccgaatgtatgaatgacattgtaaagttgtccgccgttaatcgcatcggttgaacggtcagtcacttcacctgcggcgacgtgggtaattagacgttcggcatttttgttacccatactgacaaccgatttcatttgaccggctcctgcattgttccaactgatttttacatcatcttttcctacgttttgtgtagttccggttggggcaagttttttagttgctgcaacagaatttttccccaacgcaatggaatcaccagcggcggtttcaactttcgcaccctcaccaatggcgaccgcacctgcgactttggcttcggctcctttgccgagggcgatggcggctgtggcacttgtgtgaatttttgccatttttcctaatgcaatgccgtaatcggcttcaacagttgcaatgctaccgatggcaacggctgctttgcctgatgatttggtaaattgtgagttgccgctgccggtatttgtgccgtcatcatttgccgttccgataacgatactgtacatgcctttgctcatttccgtttccgctacgccaatggctaaagaatgctcagctttagcaccatcgttgtttttattcgtttcagcctttaatttattaacagagaaatacgatactccgccaccgccggcatttttcatcgcttctcgtaactgccctaaattgacggcgtgcgtatcttccgtccccggtgcgacattcacgatttgacggtattttgtatcttttttaccgattgatagtgcaccgccgagtttgtctttgaattgatttgcaaacttttcacttatccatgttttttctttagcctcagtcttatcatcttttgtaatcataaaagtgccatttcctgacggactatcggcttcagattcagcacccaaagcgattgcatcgctatgttgactatccactctcgcattgtaaccaatagcaacggctttttgagactccacagaagaatgtgcccctaaggcggttgattgtgaaccttttgcataagcacgatgtcctagagaaatatcgtcagtttgctcagcataagattgcatacccaaagccactgtatggctaccataagcaatggcttctgaacctaatgaaacagcctctttatttgcaaatgcttgttctcctattgcaacagctttgtttccgtttgacctagctctatgtcctataattacggtttctcttattctcatccagttatctgtatcaatagtgatttgtccgccagcattcttccaatccctttttcttttgaaaataagagatttactaccaggggctagaataattgatttatccccaactttacttataaaaggaactttattatttcctcccttatcatttaaaatcgtatctggaccaatttttgcttcatcagctgtaaacccactcaaaactatattaatatcctgaccatacacaaaactcccagtcaataaaaacgccaacggcaataatttaaacagccctaaaaaattgcccgaaatcccaccgcactttggtttattttcagaacggctcgccacttggcaatttttcgccaattcagacaccactttggtttgtccggtggttacatcgtatttggttttgaaaatcttattcatggtttactctctttaatcttttaaaatgggttatttaataatttattttgttgatttttttcacttttttatggttgtgaatggattaaactttttgttttttaggtagattaatgaggtataaatcggcgatgccttgctttttaaggcaaagcagaaaaagacgaatgatattttcgctaagggttttaaaaggggaaatttgggtatgacgagaagttaaaaattttttaaaatttattttgcaaggtttataaaaaggcgttagcctaggctgtaggctgtaggctgtaggctgtaggctgtaggctgtcattttttcttttctattttatttgtcaagtaatcattaagcagtagaattttgcgattctatcctaaattttattaagaatgaaatagttttttcattttttttgtttcgatctcgattatatagtgaatcaagatgtttgaggggaaagataaaggcggagtttggcttttttttggttctaattacaggttatgttttggcgagattgctatataatgtcgaattatcttaccgatttatcaattttcttttctttgggagtaaaagatgactcaagcgaagatttattccgtttcacaacttaaccaatccgtacgccaaatgttagaagggcagttagggtcggtttggttgacgggagaaatttccaattttactcagcctgtttcggggcattggtattttagtttgaaagacgaaaatgcacaggtgcgttgtgcaatgtttcgcatgaaaaatatgcgtgtcggatttaaagcacaaaacggaatgcaggttttggtgagagcttccgtgagtttgtatgagcctcgtggcgattatcaattgattattgagtcaatgaatcttgcgggggatggcttattgcaacggcaatttgaggcgttaaagttaacattggcggctgaagggttgtttgcacaacattacaagaaaaacttaccgcactttgcaaaatctgtcggtattattacgtcgcctaccggtgcggcgttgcaggatattttgcatattttgcaacgtcgagatccgagtttgcatgtagtgatttatccgaccgcagtgcaaggcaaagaggcaacggcagaaattgtacagatgattgaattagccaatcaacgtcgggaggttgatgttcttattgttgggcggggtggcggctcgttagaggatttatggtgttttaatgaagagagggtggcaagggctatttttcattccgagttgccgattattagtgcggttggacatgaaatagatgtaactattgcggattttgttgcggacgtgcgtgcaccgaccccttctgccgccgcagagcttgtcagtcgtcatcaacaagagttattggatcaattattttatcgtaaacaacgcttggaaatggcgttggatcgttttttccaacaaaaagtgaagttgttacaacgactgcagtttcgtttgcaacaacaacatccgcaaagtcaattaaatattcaacaaaaaatgatgcaacaattacttcatcgtttacatcttgcgttaagtacttttgtcgataaaaaacagcagaaaatgaccgcactttgtcgtcgtttagataattcacctttgccttattatgtgcaaaaacagcaccaaattttggttcaattggagcttcgtttgaatagcggattacaaaaaaaattcaaaaatgccgattatcagcttagtcgattatgtggaaaattagacagtttgagtccgttgaaagtgttggctcgtggttattcgattacgaaaaatcagcagggacaggcgttgaaaaacagtcttcaaattgaggtcggacaactgatcagcacgcaattagagcgagggattattgttagtcgtgttgaagcgatggaagagtaaactaaaggtgcaaataggtttgctcctttagtttgtgtatggattggggtagttagttgcgtttaccgaaaatagcggttccgattcttaccatggttgaaccgcactttattgcacttgccatgtcatcactcattcccattgataatgtatcaattttttcatcaggaaacgccagttgtagttgagtgaataaatatttcatttgattaaatgcttgttcttgtgcggtgatattatcagtcggttcaggaattgccattaaacctcgtaggcgtaagtgcggtagattttggatatgttttgccaaaatcaacatttcttgaggttgaatacctgatttactgttttcagcactgatattaatttgaatgaggacatttagtggttgtttatagtgaggacgttgttcatttagacgagtagcaattttttcacgatcaagcgtttgcatccagtcaaagttttcagcaactaattttgttttgttggattggagcggtccaataaaatgccattcaagttgaatatgttgttctataaaatattgaattttttccacaccttcctgcacataattctccccaaatgctgtttgccctgcctgataagctatcagaatatcctcgaccggtttggttttactgactgctaataaggatactgtggaagaatgtctttttgcctgttcgcaatattgcgatatttgtcggtttattttcgctaaattgttttttatttgcatcataatgagcaagacctgttgaagttggtttgatatgggcattattttaccttaattattcgacagggggaaatttatgaaaaatttttcattttctatttgacaatagcataaaatttcggtatttctaacgcactcttttttgattttgaaataaccgaatgtataaccgcactttttctattaccacgatgattattaccattaagatgattaatggcgtgggctagtgcataaaaaataggatttacaaagcccgcctcgtaaaaaagtgcgggtttttttattaacgtttttattattaaatcttcacaacatataaggaaaaattatgcgagtactcaaatttggcggcacatctttagcgaatccgcaacgctttttacaagcagcagcacttattgaaaaagcacatttagaggaacaagccgcaggcgttctctctgcaccggcaaagattaccaatcatcttgtagcactttctgaaaaagccgctttaaatcaacctactgatggtcattttgatgaggctattgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggctcttatttggaaagcagtgtggatattgcggaatcaactaaacgagttgatgcaaaatctattcctgctaaaaatattgttttgatggcaggatttacagctggaaatgacaaaggcgaattagttttattgggtcgtaacggttctgattattcggcagcgtgtttggctgcttgtttaggtgcaagtgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgacaatcgtgaaaatatttctgaagggctacaggttaaaggcattactaatttagataatgttgctatgttcaatgtatcaggaccgggtatgcaggggatggttggtatggcagcacgtgttttttccgccatgtcaaaagccagcgtttccgttattttaatcacgcaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcattagctagtgccaatatcagtattgttgctattgcacaaggctcttccgagcgttcgatttcagcggttgttcctttgaataaggcgattgaagcggttaaagcaactcatcaggcattgtttaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaatcttggtaattggcgtgaagatttggcaaatgcaacacaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgctcgtgaaaaaggctttacagaaccggatccgagggatgatttatcagggcaagatgtggctcgtaaattattgattttggcacgtgaaatcggtttagaacttgagttgtcggatattgaggtagagggcgttttaccgcaaggtttctcagagggaaaatcagcagatgaatttatggcgatgttgccttcattggacgaagaatttgcagaacgtgttgcaaaagcaaaatcggaaggcaaagtattgcgttatgtaggacaaattgaagaaggcaaatgtaaggtttctattgttgcagttgatggagacgcaccgttatataaagtgaagaacggtgaaaatgcgttagctttttatactcgttattatcagccgattcctttgttattgcgtggttatggtgctggtaatgcggtaacggctgccggaatttttgccgatattttaagaaccttaaaacattaattggagtgataaatgttaagaatttatgcacctgcatcaagtgcaaatattagtgttggatttgatacattaggggttgcagtatctcctattgatggttcattgttaggtgatgtcgttcagattgaagaaattgaacagggatttgaactggaaagtacggggtattttgtgcgtaaattgccaaaagaaccgcaaaaaaacattgtttatcaagcctatgtgttatttagtgaacgtttaaaattacgcaatctgaaaataaagccgttgcgtttaacgttagagaaaaatatgcctattggctcgggattgggatcaagtgcttgttctatcgtagctactttagtggcgttaaatcaattttatcagcagccattttctaaaatggaattgctggaaatgatgggcgaactagaggggcgaatttcaggttcaatacactatgataatgttgcaccttgttatttgggcggtgtgcaattgatggtgcaatctctaggtaatatttgtcagcaattacctttctttgataattggtactgggtattagcttacccgggaattgaagtttcaacggcagaagctagagcaattttaccgaaaagctatactcggcaagatgtgatttctcatggtcgccatttagggagttttgtacacgcttgtcatactcggcaggaagcattggcggcctatatgatgagagatgttattgcagaaccttatcgtgaagcattattgccaaattttgctgaggttaaacaggcagtgaaggatttgggcgtacttgcttcaggcatatccggttcaggtccaactatgtttgcgattgctccggatttagctattgcgactaaatcggcaacttatttagaaaacaattatttacaaaataatgagggctttgtgcatatctgtaaagtggataatgtgggtgcaagggctttagtttaacgagaacaagttatgaatttatataatattaaacatccggaacaacaagtaagtttttcacaagctgtgcgtcaaggtttaggaaaagatcagggcttattttttcctgaaaaattaccgcactttgacgacattgatagccttttatctttgcctttggttgaacgcagtcaaaagattttaactgctttaattggtgcggaattgtcacaagaaactattagtgcaatggtaaaaaatgcctttacatttccggcaccgatggtcaaagtagaagataatatctatgccttagaattgttccacggtcccacgttagcttttaaagactttggaggacgttttatggcacaagccttagcggttgtgcgtggcgacagtaaaattactattttaactgctacttctggcgataccggtgctgcggttgcacatgctttctatggcttagaaaatattgaggtagtgattttatatccaaaaggtaaaataagtccgttacaagaaaaattattttgtacacttggcgggaatattcgaactgttgcgataaacggtgattttgatgcttgtcaagcattggtgaaacaagcctttgatgatgaagaacttcgtcaagctgttggtttaaactctgcgaattcgattaatatcagtcgcttgttggcacaagtttgttattattttgaggcggttgcacagttaccgaaagaaatccgtcaagacattgttatttctgtgccgagcggtaatttcggtaacttaacagcgggattaattgccaaaactttaggcttaccaatcaaacgctttattgcggcaaccaatgccaatgataccgttcctcgctatttgaatagcggaaaatggcagcctcatacaacggttgcgactctttccaatgcaatggatgtgagccaaccgaataactggcctcgtgtagaagaattatttaaatataacggctggtctttaagtgaattgggttcaggtgcattgagtgatgaagaaacagaaaaaaccttgcgggcacaatatgccaaaggttatttatgcgaaccgcatggggctattgcgtatcaggtgctaaaagatcaattacaggttaatgaaacgggtattttcctttgtacggcacatccggcaaaattcaaggaaaacgttgagcgtattttaagtctcgagcttgtgcttccggaaacattggataggtacaacaagttgccattgctttctgatgaaatggaaaatgacttcgctcaattacgtgcttatttattaaaaaaataaagcattttaaattaaaagtgcggttgaaagtcggaaagtttcgattttatgtacatataataaaagagtgggattcccactcttttgtttgctgtactgtttttttagacaagaaaaacttttaattcgggagcttatgcctcttattttcttgatagacttgcttgaattttattttttgccactttcatcacagttttgtacattgctacattttccgtaaagatacagattgtgtgtttttaatttgatgccatgttccgcactgatttcacgttggcgtttttcgataacttcatcattaaattcaaacactttgccacaatcgacacaaataatgtgatcatgatgttcttccggtgctaattcaaaaacagatttgttaccttcaaagttatggcgaataagaatatttgcctcatcaaattggttaagtacacgataaacagtggctaaaccaatatctttaccttgttccagcaacattttatagacatcttcggcggagaaatgttgcattgtgcctctactttcttgcattagagacaaaattgttaagcgtggttctgtaatttttaaacctgctttttttagtagcttgatattttcttcagacatggtagctcctcaaattttatgccagttcagctaaacacatttcgtcatacacttgtttaacccatttttctacacgttctgcggtgagttctggttgacgatcttcatcaatacataaacctacgaatgtattgtcatcaactaaggcttgcgagacctcaaaagtataaccttcggtcggccaatgcccaacgataattgcacctttgggctcgataatattgcgtaccgtacccatcgcatcacagaaatactctgcatagtcttcttgatccccacaaccaaaaatagcgactaatttatcggtaaaatcaatttcttctaaggttggaaagaaatcgtcccagtcacattgggcttctccataataccaagttgggataccgatcattaaaaaatcatagctttcaatgtcttctttactacttttagcaatatcacgaatatcaatgagttctgaacctaattgtttttgtatcattttagcgatattttcagtattacccgtatcactaccataaaataaaccgacaatagccatttttatctatttccttgaattttaaaataatcttttaagatcgttataattaactctcaatgactaatcgcttgttcagacgcctgacttctaactgctgaactaaatccgcatgtaacttttactcaatacgctttaaaatgctaaatttatcgcattgaagttgattacatttgtttattcggagctgttgttcatgaagcagtgaatttgttctagacgtcctactttgggaagcgtcgcaaacagatttagtgtaatacaatctgcatcttgtttagccgttttcaaaccactgaaaatatatcaattctagcctggttctaattgagaatgataagctaaaagcaaaatttgaagcgaactataacacaatttataagtgaattaaaccctatagatcaagtaaacatgagaatttttatgacaaaaaacgctgaattgatctaatcacaaaatccgctttttcagcatgtacccaatgcccgcttccattgatggtaaaagaggttgcttgtggaaattgagcaagaatttgctcgctgtattccggtaaaatgtaatttgataatccgcctcggataaacagtgttggtttgttaaaaaatccttttttccaatccatgatctcagcgtaattttgtttaagtgcggtgagattaaagcgaaatttttcttttgcttgtgcatcgaaagacttgagcataaattgctgtacgctttcttgtggaatatagttagccagtaattgttttgcttgttgacgagtttccgattgtgctttacttacggcaaaaagtcccgcaaatacactgtcgtgttcattgttgctatagttgaccggtgcaatatcaatcacaatgagcttttctattaagtgcggtcgtagcattgcacatttcatcgctgtttttccacccatagaatgcccaattaaaataacgttggttaaattcaaatgatcaatgacttgtagaacatcttccgccatcagctgatagttcatttcttcactatgaaaactttgtccatgattacgtaaatcaagacgtaaaatagggtatttttcggaaaaagcacgagcaatgacaccaagattattcatatcaccaaataaaccgtgaatgaaaacaagagtgggtgagatttgcgagttgtttatagcgtgaaattggtaattgagtaatttagtcgtgggcataatttttgcgtgtgtatttgtaaagaaatcgttataatgtgcgaaaaattcaaatagatcaagtagaaatctcttgtaggcttgtaatgtaaaaggagttcggttatgaaaattattgaagttgacgaagagctttatcagtatattgccggtcaaacgaagtctatcggtgaaagtgcgtctgatattttacgccgtttgttaaatcttccttattctaaagtagcaagtgcggtacaaaattcggaaaatgtatctacagaagcgattttaccaaacacttgtatagaaagtgaacaggaagttcaaacgaacgaattaataaatattcctgtcaaaaagcagtctgatgaagctattcagaaaattgttgataaagtaagaaatcttttatattcagaagaattccagcaagaaacaaaagctgttgtgcgttttttgagcttgttgcgtacactttaccgcactaatccggaaagttttgcattggcaacggaaagtttgcaaggtcgaacaagagtttatttcgcacgtgatgaggctactttactggtagcgggtaatcatacaaaaccgaaacaaattcccgacactccgttttgggtgatcactaatactaatagcggtcgaaaaatgttgatgttggaaagtgcgatggaatctatgcatttaccacaagaactcattgaagaagttagatctttttttgtgacgaattagcgatgttcctttggcataaatatgcactcactcccttatttcaatcaaaaatagccttgcgaaactcgcaaggtgaagtctttacttggcaacaactttgttctttaatcaatcggcaatctctactttttcagcaacaaggtgttaaagcaggttcgggcgtgttgttatgtggtaaaaatgatttttcattattgttggcttatttggcaacaattcagttgggagcaagagttttaggtgttaatccgagttttcctgccgataaaattcagcatatcgcagaatgttatcaatgtgattttatttttaataggactgctttcctgtttaaaaatatgcaaaatttgaccgcactttctgtgagcgactgtacgcaatatgtagatgttttacctgaaactgaagttaaaatggatttgcaggctgtggcaactttaactttaacttcaggatcaagtggtttaccgaaggcggttgtacatagtttgcaggggcatttagataatgcgattggcgtttgtgagttaacccaattcagtgcaaaaaacagttggcttttatctttgcctttatttcatgtttccggacaggggattatttggcgttggttggtaagcggtgcagaattgcatttaccgcaagaggatttttatttttctgttagtcaggcaagtcattgttcgttagtaccgacgcaacttcaacgtttattcgattattggcaacaaaatcctactctcccacgttacacacagcatattttgttaggcggtacgcaaattcctacgcagttgactgagaagttggcacaatacagtataaaaagttacaccggctacggtatgacagaaatggcttcaacggtttgtgcaaaattgagtgatggtaaacgtggagtagggctgccgttagcggggcgtgaagtgcggttagtttgtgatgagatttgggtgcgaggtgctggtcttgctttgggttattggcaacaaggtaaaatttgttctttactgaatgaacagggttggtttgccacaaaagataaaggtatttggcaagataatgaattgcacattttaggacgcttagataatatgtttatctccggcggggaaaatattcaaccggaagaaattgaacaaattattggacagaatgaaacggttgcacaggtttttgtattgcccattgatgatgttgaattcggacaaagaccggtggcaatgattaaatttcacgatgttttttctgaacaggcagtacatgaattacatatttggttagcggataaattggaaaagtttaagcaacctattcaatattttccattgctgttgcaatcacaaggaaatatcaaaatttctcgtcatcagttaaagtctgagctaactcgtttattaggaaagtaagtatgaagaagataaaaaataaattcaaacaagttgccatgattggcttattctctttagctcagtttgcactggcaggagcaattttgaccgaaaatgatgtaaagatgcgacttgatgagattaaaaaaatcgaacaaccccagcaagaagataaaagtgcggtgcaaaacttggaagaaacattgtttctcttaggaaaaatagcaaaacagaaagaagacaatctaaagttacaaaaactgattcaagatgcaccaaatgagcaaaagaacatcagagaggaaatcactacgttaaaagaggcgtttgttgttcgtgattttgataatttgtccatcgggcaattagaggataacttagcaaaaatacaatccgaattacaacaagttcaagctgatttagtacaagctaatgcacagttagttaatcaacattccgcaacagagcgggcacaaagtgcgttaagtgccaatattgttcgtacacaagaaattgataaattgtcttttagtgttgatattgcacctgaggagcaaaataaattagctacagaaagtgcgttaattgaattacaaaatgactacaatcaaactgtattacaagggaataatgaactcaccgcactttatactttgcaattggaattgaaaaatcttgtccaacagcatttacaagctacgcaaactgcgttacagacggaaattaatcgacgtaaattagtgcaaactgagcaacaggtggagcaactaaaacagactcaaaaggaagcagagggtaatccgttattagttcagcaacaacaaattaatattcagattgggcaagatttagtggaacaaacaactaagctgaacgttttgtcgcaagacaatttgcgtattaaatctgttttggataattttcaacaaactgaacgtaatattaatgaacaaattagtgctttacagggaactttagttttatctcgaattattaataagcaaaagcaattattaccgcacgataggatgattacaggattatcaaatcaaattgccgatttacgtgtgaaaattttcgatttaacggagttaagagatagcctttatgatattgacggttatatttccaatatagaaagaaagcaaggggttacttttggaatagctgaacacgcacagctcaccaaaattttacgggagcgtcagaagggtatttctgatttggtgtctattttaaatgatcaactcaatctttcaatcaatattgaattaaatcaaaaacaagtcaatttaattagtgatactttacaagaaaaactccaacaacaaagtttctgggttaagagtaatacacctattgatttggattgggttaagcgttttccttcactactaaaaatagaattggaggatattcgtacgcaatttaatttcaacaattggcaagataatattatttctgccactgcgttaattgttttccttttatccatcgccttttttatttcttggcgtaaagaaaaaattaagcaacggttgaattatattaatagcaaaattaatacgttacaggaagatagacagctttacactccggaagctgttttttggacgattattctttgtttaccgatgacgttagttgtcttagtcggtttaattgttattacttttatttgttttaatgatcctgaaaaattctggttgtggtcagtaagaatgtcgggttattggtggcttttcgcttttatgttagcgatgttacgcccaaatggccttgcttatcgtcattttagtatgcctaaatataatgtagagcttttttccaatgtgatgaaacgatcagtatggattactgttctttggcttaatgcctctatgtttacttatttagatggaggaattgctaatgatgtgattggtcaattgatgacaattgcggtcttagttatttcactgtttattattggacctcgtatgcgttatgcagtccaagcttatgaaaaaaactcagaaaaaaaacctttcctaaaagttttccgcattgtgttgctactctctcctattattctcattgtgttggtagttttaggttattactacactacgttaaatttgatggatcatttaatgtcttcttattttgctttgatgatatggatagtaattcgcaatatagtgtatagaggatttactatttctgctcgtcgtttagcttatcgtcgtttgcaagaaaaacaaaagaaaacacaggtacaatctcaagatgtggtggataaagaagagtttaaccttaatacacaagaggaagttttagcaatttcagccgttaaggatcaagttttgcgagtgatggatttagttttactcgtcggcttaatcggtatgttctattgggtttggtctgatttaattacggtagcttattatttggaaggcgtaacgttatggaatcaaaccgccataacagaagttggtacagttattgaaactattaccctgtggaatttgttattagcactgattattttaggcatcacgtatgctttagtgcgaaatattggtggggtattggaagtattaattttttcaagagttaatttctcacaaggaacaccttacaccataacaactttactgatttattttatcattgcaatcggtagtgctatggcattctctactttgggtatgtcatggtcaaaattacaatggttatttgccgcactttctgttggtttaggttttggtttgcaggagatctttgctaactttgtatcaggtatcattattttatttgaacgtcctgttcggattggtgattttgtaacaattgacaatttttcaggaactgtgtcaaaaattagaattcgttccacaacaattatcgattctgataagaaagaagttattgtacccaataaagcctttgtaacagagcgaattgtgaattgggcattgaccaattctatgactcgtgttgtgattggtgtcggtgtggcttacggttcagatttagaattggttcgtaagttgttgttgcaggcagcgtatgaaacacctacggttttaaaagaaccggaaccgtctgcttattttatagcgtttggtgcaagtacattagatcacgaattgcgggtttatgtgggtaaattgtcagatcgtatgactacacaagactttttaaatcgtcgtattaatgaactatttgcacaacataatattgaaattgcatttaatcagttggatgtatttattaaaaatcaaacaacaaatgaagaagtaaaagtactttcagagaatttacaaagataaaaggaataaaaaaatatggcgggaaatagtattgggcaacttttcagggtaacgacatttggagaatcccatggtattgcgttgggctgcattgtagacggtatgccgcccggacttgctttatccgaagatgatattcagccggatttggaccgtcgtaaaccgggaacttcaaaatatactacgccacgccgtgaagaggataaagtacaaattttgtccggtgtgtttgacggaaaaaccacaggaacaagtatcggtatgataattaaaaataccgaccaacgttcgcaagactatggtgaaataaaagatcgttttcgtccggggcatgctgattttacttaccagcaaaaatatggtttacgtgattaccgtggcggagggcgatcttctgcacgtgaaacagtgatgcgtgtagcagcgggggcaattgctaaaaaatatttgcgtgagtattttggtattgaagtacgaggttatttatcacaaatcggtgagataaaaattgatccgcaagtggtagccgatgtgagtaaaattgattgggcgaaagtaaatagcaatccatttttttgtcccgatgaaagtgcggtggaaaaatttgatgaattgattcgagaattgaaaaaggcaggaaattctattggggcgaaattaaccattgttgctgaacatgtgcctgtcggtttaggtgagcctgtttttgatcgtttagatgcggatttagctcatgctctcatgggaattaatgcggtaaaggcggtagaaattggtgacggttttgcggttgttgaacaaaaaggaacggaacatcgtgatgaaatgacaccggaggggttttgttccaaccatgccggcggtattttgggcgggattagctctgggcaaccgattatcgctaccattgcgttaaagcctacttcgagtattactgttgtagggcgttcagtgaatttaaataatgagcctgttgacgtgattactaagggacggcatgatccttgtgtgggaataagagctgttccaattgctgaggcgatgatggctattgttttattggatcatttattacgctttaaagcacaatgtaaatagaacacataactatgttaagaaaggtaaagttaatgctgaaaactgcggttttttttaccgcactttttttcactcagatattaagtgccaatccacaatattggcaatcagtgaaacggcctattcatggtgaggcaatgcctataggaagttataataatggctgtcttattggtgcggaagcattgccctttaatggtgagggatatcaagttattcgtactaataaaaatcgttattatggacatcccgatatgattgcttatttgcaacgtctcggtaaaaaagcaaaacaggcaggtcttccaacgattttaatcggtgatattgctatgccgggaggaggacgatttttaacaggacatgccagtcatcaaatgggacttgatgcagatatttggttgcgtttaggtaaactttcggctaaagatgcacaagatccaagtggaatgggactgttggttgttgaccgaaaaaaacagagagtcattgataaattgtggtcaaaagatcatgaaaatctgattcgtttagcaactcaagatccacaggtcagccgaatttttgtaaatcctgcgattaagttgaaattatgccaaacagtaaaaggtgatagaaattggctacaaaaaattcgcccttggtttgggcatgatagtcatttccatgtgcgtttaacttgtccaaaagatgctaaatactgtgaaaatcaattgccaattccggcgggagagggatgcggtgaagaactttattcttggtttaaacctgctaaaccaagtgaatttaagcccaaaaaagtggtgccggaagccccttttctttgtcaacagttaataagtgcaccaaatcgtcatgaatggttagaataggaataatacgatggtagaaatgagtattcagttaatgttaattttgttttttgtcgctatgatagccggctttattgatgcaatggcaggcggtggcggtttgattactattcctgcactattgatgactggtatgtcgccggcattggcacttggtacgaataaattacaggcttgtggcggttctttttctgcaagtttatattttttacgcaaaagagcggtagatttacgtgcttttttgttgattattgtcatgacttttttgggggctgcattaggcactttatctatccaaagtgttgatgcaatcttaattaagaaagttttgccttttttggttttgattattggcttatattttttattgactccatcacttggtaataaggatagacaaccccgtatttcttatagtttatttgcattcagtatcggtctgacagttggtttttatgatggtttttttggtcccggaacaggctctttactgactcttgcttgtgtaagtttactcggttttaatttagcaaaagcaacggcacatgcaaaagtgttaaattttacttcgaatattgcatcattgctttttttcttacttggagaccaaattttttggaagttgggcttggtcatgatgcttgggcaatttattggtgctaatttaggcgctaaaatggtattaacgaaaggaaaaaccttaattcgtcctatggttgtattaatgtcttttattatgacggttaaaatggcttatgagcaagcttggtttagctggtaaaccgatgaattattggagtaaacatgacagaaaataatgatttacgtttaaccgcacgggtcggatatcaacctcattactcttggtcctatttattgcctaaatattggggtatttggctcggtatttttgctttagtaattttagcttttgttccttttcgctggcgagataaattggcgacaaaattgggcagaattatcgctcgtaaagcgaagaaacagagacatcgtgctgatgttaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagaggtaggaaaaaatattattttaatggtgccacatggttgggcaattgatgcgtcggggatcattttacatgcacaaggaatagcgatgacttctatgtataacccacatcaaaaccctcttgtggattggttatggacgatgactcgtcagcggttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagccactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttagcttgggcaatttgtgctaaactttgtgccgttttgttgaataaacttttctcatagaatcagggaataaaatgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagtcggggatttatttttggggcgcctgttgctttggcgttaaatgttccctttattttggtacgcaaaccgggcaaattacctcgtgaaactatcgcacaatcttaccagttggaatatgggcaagataccttagaaatgcatgtaagttctattcaagccggtgataatgtacttgtgattgatgatttattagcaactggtggaactattgaagcgactgtaaaactggtagagcgtttacaaggtcaagttaagcatgccgcctttgttattagtttgccggatctcggtggtgaggttcgtttacgtgaacttggtgtggagccatttactttagtcgaattttcaggtcattaatttcttcaaattaatagagatagataggcaatgagttatcaagtattagcaaggaaatggcgtcctaaaactttttctgaggttgtgggtcaagagcatattttgaccgcactttctaatgggttatgcgaaaatcgcttgcaccatgcctatttgttttctggcactagaggcgttggaaaaacttctattgcacgtttatttgccaaaggtctgaattgtattaggggggttacggcagaaccttgtggtgaatgtgaacattgcaaggctattgaggaaggtcgttttattgatttaattgaaattgatgctgcttcacgaactaaagtagaagacaccagagagttgcttgataacgtgcaatataagcctactcaaggtcgctataaagtttatctgatagatgaagtgcatatgctttctcgtcattcttttaatgcgttgttgaagacgctggaagaaccgcctgaatacgtaaaatttttattggcaacaacagatccgcaaaagttaccgattacgatcctctcacgttgcatgcaatttcatctaaaagctttatcagaaaaacaaattgcacagcatttagaatttattttacaacaagaaaatattccttttgaatatcctgctttggaaaaattggcaacagctgcacaaggtagtattcgagacagtttaagtttaactgaccaagctattgctatgggcaacgctaatgtaagtttggatacagtaagtatcatgctgggcttattggatgacaatcagcctattgatattttatatgcgttacagcaaggcaatggtgaaatgttaatgaaggcaattcaagctgtagcggaaaaaggtgctgattgggataagttactggtaactttagcggaaaaattgcatcaaattgccatgctacaacttctgccacagcaaataaatgaagaaaactcgcttggatttttagctaaacatattacgccggaagatgtacagtttttttatcaggttattgttagcgggcgtaaagaattagcatctgcccccaatcatcgtattggtgccgagatgattttgttgcgatccttagcgtttcaccctaagttcattagtccttcttcagcagcaccaatagaacaaagtgcggtgcaaaaatcacaaaatattgttcaaccgcctttagttgagatgcccgttgtttctgttgccgagcaattaccttcgcaaaatctcattcgtaaaccaacgatagcagataaggtcgatactaagttaagtacaacagctttaagtgctttagaagcgttagaacagttgtcacaacctagtgatcattcagatagcgaaaaaaaaaactcgccgatagataatatttatgatatttctttaagagaaaatactgaaaatatctccgcacttcctgttctaaatgttgtgcctaaagatgttgataatgcacttaagacggttactgtcattgataagagtgatcatagaagtgatgaaattcaagaggatagtgctgagaattatcgttgggaatggcgaaatccggaaatggcggttgaggaaaaggctattcgtccttctgaaataaagcaagctattttagaacaagcttctccggagctcatacaacgtataattgctacggcacaagaaagagatgattggactcggatcattgagcaattacctttgagaggtatgacaaaagacatggcgttaaataccgttctattaaatcaatcgggggatcagatcgttttatccttaatgtctgataaacagcatttgttagatcgttgtcataaagaattaaagcaagcattatcggatttctatcaacgtgatattcagttattaatcacacctactgacgataaaaatttagccactcctttatattatcaaaacttagtttatcaagagtttaatgagcaagctaaaaaagcgttacaagaagataacagcctaaaattattagaaaaagaatttgccgctacgctggatttggatagtgttagaccgatttgacatttttactacgatttagatattgtcttgagctttgagcaatgattatataatgatgaaaaaagctaaaaatcgaccgcactttttctttatttgcgatccggatcgcataaatgttttttgatgacaaattctcttttcccaaatacaagaaaattgctagattaatcctattgaacaaagtacaatctccgcctctttttgatcatcaatgaatgccataaggtgtaataacggggcaataaataataaatgtcggacaaaattaatttaatgaatttaactcgtcagcaaatgcgagcattttttcaggagttaggtgaaaaaccttttcgagcagatcagttagttaaatggatttatcattttggtgaagataatttcgatcatatgactaacattaataaaaaattacgtgaaaaattaaaaactgttgctgaaattaaagctccggaaattgcagttgagcaacgttcagctgacggtacgatcaaatgggcaatgcaagtaggagatcagcaggtagaaaccgtttatattcccgaaacggatcgtgctacgttatgtgtatcttcacaagtagggtgtgcattagcctgtactttttgttcaacggctcaacaaggttttaaccgcaatttaactgtatctgaaattattggacaggtttggcgagcttcaaaaattatcggtaatttcggtgttaccggtgttcgtcctattacaaatgtggtcatgatgggaatgggagagccattattgaatgtggctaacgttgtaccagcaatggaaattatgttggacgattttgcttatggtttatctaagcgtcgagtgactttatccacttccggtgttgttccggcactagacaaactgagtgaaatgattgatgtggcattggctatttctttgcatgcaccgaatgatgaattgcgtaatgaaatcgtgcctattaataaaaaatataatattaaaatgttgatggagagtgttaatcgctatttaaatgtttcaaatgcaaatcatggtaaggtaaccattgagtatgttatgttagatcatattaacgatgggactgaacatgcacatcaattggcagaggttttgaaaaatacaccgtgcaaaattaatttaattccttggaacccgtttccggatgcaccttatgccaagagttcaaatacacgcatagatcgttttcaaaaaactttgatggagtatggttttacagttattttacgcaaaacaagaggtgatgatattgatgcggcatgtggtcaacttgctggtgatgtgatagatagaacaaagcggacggcacagaaaaaacggtttggaaaagaaatcggcactcatcaaatttattaactatttttaatgtataaggagagaaaactaatgcgatatcggactatatttacttttattatattctctctttttctttctgcttgcgtttctcagcctacaactggtcgctttaataagcaacaagctgcaaaagcacgaattgagttaggtttaggttatttaaaattacgcaatttttctcaagcaaaacttaattttgataaagctttattctatcaacctgactattatttggtacattcggcttttgcctatttatatcaattacaaggtgatatttcgcaagcgaaatcctcttatgaaaaagccatcagtttggataagtcgcaaggtgatgtgaaaaataattatggtgcatttttatgtagtcagggcgaatttgctcgtgcttatgagttatttgagcaggcacttactacgcctaattattatcagcaagcggatacctatgcaaatatcataatttgtgcagaggcggaacataatattccacgttatcagaaatttttacagttactgaagaatattgatcccaaaagagcggaggaaataaagaaagtttcttagcttagttagcgtgagttgaaagatcaaaaatggcaagactgtcttcttgccatttttattatattatgattttttgatgtaattagattttacaagctcctcctgcacaagcgtcatcaagatcttcttgcatatcttctgcaccatctctagtgttttgataatacagggtttttaatccatatttgtaggcagttagtaaatcttttaataaaaccttcattggtactttaccatcttcaaaacgttttggatcatagttagtattcgctgaaattgcttggtcaatgaatttttgcatgataccaactaagtgtaggtatccatcattacttggaatatcccacagtaactcatagttttcacctaaattctcataatcaggaacaacttgctttaaaattccatcttttgacgctttaatactaacatgtccacggggaggctcaattccattggttgcattagaaatttgagaagaggtttctgatggcattaatgcagttaatgttgaattacgtaaaccaaattcttgaatttctttacgcaaggcttcccaatcgtaatgtaaaggctcttttgttaagttatcaatatcttttttgtaagtgtcaataggtaagatcccttgtgcataagtggtttcatggaagtattcgcaagcaccaatttcttttgccaaattcattgaagcttttaataagtaatattgaatagcttcgaaagtgcggtgtgttaaatcattcgctgaaccatcggagtaacgaacattattttttgctaaataataagcatagttgataacaccgataccaagagagcgacgagctaatgaactgcgttttgctgcagcaacagggtagtcttgatagtctaatagggcatctaatgctctgactgcaagatcggctaattcttccaactcgtctaaattttcaagagcacctaagttaaatgcagataatgtgcaaagtgcaatttcaccattttcatcatggaaatgttgcaacggtttggttggcaaggcaatttccaagcataaattagattggcgaattggtgcaaccgtaggatcaaatggcgaatgtgtgttgcaatgatccacattttgaatataaatacgaccggttgacgctcgttcttgcattaataaagaaaatagctcaacggctttgacactgcgtttacgaacagcgggatcttgttcatatttgagataaagtgtttcaaatttattttggtcagcaaaaaatgcttcgtataaccctggaacatctgatgggctaaatagagtaatttcaccccctttaattaagcgttgatacatgagcttattgagttgaactccatagtccatatggcgaacacgattgtcttcaacccctcggttattttttaataccaataaactttcaacttctaagtgccaaattggataatagacagttgccgctcctccacgaacaccgccttgtgagcaagattttaccgcagtttggaaatgtttatagaatggaatacaaccggtatggaatgcttctccattacgaatcggactgcctaaagcacgaatagcaccggcattaactccaatgcctgcacgttgagaaacgtatttcacgatggctgatgctgttgcattgattgagtcaagactatcaccgcactcaattagtacacaagaactgaactgacgagtcggggtacgcacacctgccataattggcgtaggcaaagagattttaaaggttgacgtagcatcatagaagcgatgaatgtagtccagacgagtttcttttggatatcttgaaaagagacttgcagcgactaacaaatataagaattgtgcagactcatagatttcacctgttactctattttgtacaagatattttccttccagttgtttcacagcagcataggagaatgtcatatcacgccagtgatcaaggaaaccatccatttcatcccattcttcacgtgtataatctgttaataacgcctgatcatattttcccatccgcacaagtttttttacatgatcataaagttttggcggctcgaaatgtccataggcttttttacgtaaatggaacactgctaaacgagcagctaaatattgatagtcaggactatctttactgataagatctgcggcggctttaataatagtttcatgaatatccgaagtgcgaattccttcataaaattgaatatgcgattttaattcgactaaggaaacagaaacattttccagtccttctgccgcccaagtaatgactctgtgaattttatctaaatcaataggttctttgtttccgtcacgttttgtgaccatcaatgctttattcataggatttccgagaggttctgatatggttaaaacacaagatatagttataaattaaaaacaggctacaagataatgtgttggctggaaaatttcaagtaataaatttcatctatgattcttgacagaaaataacttacttataaataagtaaaaaattaaaaagtaataaaaactattatcaaaaattgtgctgcagatcaaaatttatattttttgatatgaataaaatgatctttattctttgtggcaataaaaaagccgttcaaagaacagctttcaagggttattttcctaaattatcaaagaatttttttacaccatctaaaaaacctgaggatttagggcgttggagcgttttaccttctaaactttcttccaattttcttagtaactctttttgttcttcgtttagtttaattggtgtttcaataacgatctcgcagattaaatcgccagcatagccgcgagaggtaatgccttttcctcttagacgaagcagtttaccggtttgtgtttcagcaggaattttaactttaagacgaccgtctaaagttggaatttctacttcgccacctaatgcagccatagtaaagctgatagggacttcacaataaagattgttaccatcacgttcaaaaatatggtgtttttttacatggataaccacatataaatcaccggcaggtgcaccattttcacccgctgcacctttacctgctaaacgtaattgattacctgtatctacgcccattggaatggtaacggtaagattttgggttttatgaactctaccttcaccgtgacaggtatgacaaggtttctctatttttttgccagtaccgtgacagtgtggacaagtttgttctgtaacaaagaaactttgttggcgacgaacacgacctgcaccatgacaggttggacaagattcaatttttgaacccgcttccgcacctgagccatgacaagttccacagtgaacaagagtgttaatttgaatatcttttttacagctttttaccgcttcttccaaacttatttcaatatcgtagcgtaaatcctcaccacgaacaacacgttgacgagaacgtccgccaccaaaaatatcgccgaacatatcgccgaaaatatcaccaaagtcagctccgctaaagccgccgaaaccgccggcaccaccaccttgttcaaaagcggcatgaccatattggtcatacattgcccttttctctttatcagccaaaacttcgtatgcttcattaatttctttgaatttttcttcgctttctttatcacctttagttcgatctgggtgatatttcatcgcaaggcgtttgtaagcacgtttgatttctttatcatccgctcctttttgaacacctaatatttcataataatctcgttttgccatgtgtaatccggttagttgttgcgttataaacgctgatagtcatacgttgaaagggcgtattactacgcccttgactctgattagtgagatatacagattatttatcttttacttcttcaaattcagcatcaacaacatcctctccacctttcgtactttgagattgttgtgcaccggcatcagcttgtgcttgttgttgacttgcttgaagtagtttttcggaaacttgaattaatgcttgtactttggcatcaatttcagttttatcttcaccttttgccgcagtttcaagttcattgaccgcactttcaattggtgctttgtcttcagctgataatttctctccaacttctgctaattgtttgcgggtactatgtactaagtgatccgcttggttacgagcttgaactaactcttcaaatttacgatccgcttccgcattagcttccgcatcacgaaccatttgttgaatttcttcatcacttaaacctgaagatgctttaatcgtaattttttgttctttaccagtacctttatcttttgctgaaacatggataataccatctgcatcaatatcaaaggttacttcaatttgaggcataccacgtggtgcagggttaataccttcaagattaaattgacctaaagacttattggcagaggcttgtttacgttccccttgaagtacgtgaatagtcaccgcactttgattatcttcagcggttgaaaatacttgcgattttttcgtcggaattgttgtatttttctcaatcaaagttgtcatcacgccgcccattgtttcaataccgagtgataatggtgttacgtctaacaataaaacatctttaacatcaccggctaaaacaccgccttgtacagctgcaccaatagcaaccgcttcatccgggttaacgtctctgcgaggctctttaccaaagaattcagcgactttctgttgtactaacggcatacgggtttgtccgcccaccaaaatgacatcattgatttcggaaacgcttaaacctgcatcggaaagtgcaactttcacaggctccattgaacgtgcaactaaatcttccactaacgcttctaatttcgcacgagtcaatttaatgtttaaatgtttaggtccggtagcatcagcagtgatataaggtaaattgacatcagtttgttgagcggaagaaagctcaatttttgctttttcaccagcttcttttaaacgttgcattgcaagtggatcgttacgtaaatctacgccctgttcttttttgaactcatcaactaggtagttaattacacggttgtcaaagtcttccccccctaggtgagtatctccgtttgttgctaaaacttcaaacgttttttcgccaccgacttcatcgatttcgataatagataagtcaaatgtaccaccacccaagtcataaacggcaattgtttggttgcctttacctttatctaaaccataagcaagagccgccgctgtcggttcgttaataatacgtttgacttcaagaccggcaatacgtccggcatcttttgttgcttggcgttgtgcgtcattaaaataagccggcactgtgattacagcttccgtcactgtttcacctaaaaaatcttccgcagtttttttcatttttttcaacacttcagctgaaatttgcggaggtgccattttttcaccttttaccgatacccaagcatcgccgttatcggctttagtgatttcaaaaggcataatagcaacgtcacgttgtacttcttgatcttcaaagcgacgaccaattaaacgtttgatcgcaaataatgtatttttcgggttcgtcacagcctgacgtttcgctggttgtcctactaaggtttcattatcatttgtataagcaataatggatggggttgtgcgttcgccttcagcgttttcaatgacacgtggtttgtcgccgtccattacagccacacaagagtttgttgttcctaagtcaataccgataatttttcccataatatgttttctcctagtatctagtataaattcgttgacagtttcaagattgggataatgattgcaatttcaagtgcatggaatgcaaaattttgaaagtgcggtcattttttgccttgttccgtaaaatgtgattggaaatgaaaaattcaagaggaaaaatgaaattttatgtaaattaagttaaattttgttcaataaattgctgtttttttatttgaatcgcaatttctctccgacgatccagttctactcgaattgctttatgttgaaagccttctgaaataatctgttgcacattaacagctaaagctgcttggtagaggcacaacaaaaatttgtattgtgggcaatcggtatagttcatttcggtttgagtcagactatcagcaaggcaaactaacattaattcttcgaagcgttttggtttacgccagacatctaacttattaaataacgttaagattgttttggtgtgcaatgccaaagcatgatgaatatgagaatgatattggcaagttaattctgccagttcttgaacatagttagggactttaaaacgctgacagacatttctgagataagcaatacttgttattttattatcatgagaataaggggggatattggcggttgagagagcttttcccacatcatgacaaagtgcagcaaaacgtaccgcacttttgtgataatccgttttttcggttaacaatgttgtttgcttaagaatgggcatagcatgcacaaaatcagtcatgtctgagcgatattgtatagagtcggaattaaacacactaatttccggacataaaacttttagggcatctattttttgtaagatagcaaaataaacttgtggatcctgttcatgtagtgctttttctgtttcttgccacactctttccggagaaagttgtctcaactctccattattggctatttttttcattaaggctagcgtatctggtgcaattttaaagcctaattgatgataacgggcggcaaagcgagctactctgagaactcgtaagggatcttctgcaaaagccggcgaaatatgacgtaaaataccttttttcaaatcggcaataccattgtatggatcatgatattgccccgccatatcctgagcaatggcattaatggttaaatcacgacgcatcagatcttgttctaatgtaatattagggttgaaatcacaaataaaaccagtatagccggtacctgatttccgttctgttcgtgcaagtgcatattcttctcttgttttaggatttaagaaaacaggaaagtctttaccaacttgttgataaccctgagagagtaattcttcagctgttgacccaaccacaagccaatcacgatctttaatgggtaagccaagtaattgatctcgaacagcaccgccaacaagataaatttgcatcatatcgttaagaccaacgattttggcgacggcgtttcggaattagtagaggtaaaataagaccaagcaataatcctgcacctaaaacagagccaccgtagataaaccactgaatagcgatttctcgtttacccacatctaacatcgcttctaaatcacgatttttattttttgtaatttccaattccctattaaggagtgagttttgttccagtaatttgctactttgttcttctgcttgtttggtacggcgttgcatctcgcttgttcgttgtttccagtcattgtcaatattattgagctttagagttaactcttggatttgagcttttaattttggattttcttccctactacttggagtactggttaattcacttgttaaaatccatgcttcacgattacgtttgtcacgaattaaggaatatttatcttttttatccagtacggtaaccgactcgcctgcttgaatagttcccgaaattttaaattgatctcctgcacctcgtcgcataaacgttgtgagattttctttcacgtattttgtttcggcataagcgttggataaggaaaatcctagtagaagagcggatactaaaagagaggtaatttttttcataataaatccaaaaaataaggtcaacaaaaaagtaataaaaagtgcggtagattttaccgcacttttttttgctgacaagtaatgatttattttatctttgagcgttaatgaaaaatcgcataaataatgtaataaatcacaatagcaaagaaagtacccgcaggtaatgtaacaatccaagaagcaacaatattacgaataacggttaagttaattgctgcaataccacgtgcaaaaccaatacctaaaatagcaccaacaagtgtttgagtcgttgatataggtaatccggttcctgatgctaagacaactgttacagcagtagcaaattgggcagcgaaaccacgacttggcgtgaggtctgtaatgcctgtcccgatcgttgacattactttataacccataacaattaaacctactccaatgccgacagagccaagaggcaggatccaccaagccagggtagtttttcctgcaatctcaccaccatgttctatgatggaaacaacggcggacaaaggaccaactgcgttggcaacgtcatttgaaccatgagcaaaagccattgcacaggcagttaatagcattaaaatactaaatactttttcaactgctccaaaggttcctttcgtaacattttgaatgaaacgttggctacgaaaataaaaagaaccaagaatacccgcaataatactaatgataccggatataatcagtgtttctatggtagttaaatgtaatccaatatgttttagccctttcgtcatagttacaatagctaaaataagaacggtcagtcccatataaaaaggtccgtatttttgggcattagctaaaggttttggcgtgtcaaagattaacttttgtgtactaaagaaaatagcgtaagcaataattccggcgagaataggggtgataaaccaacttcccacaatattgcgtacagttccccaatcaactgcatgtgcaccgacagtaatacaagcaaaaccgacaattgcaccgataattgcatgagttgtagaaaccggccaacccatttttgaggcaattaataaccaaatccccgatgaaaaaagagctgccatcataccgaaaaccaaaatttccggagtatcagtaaactgcattggatctataacgccgcttttaatcgtttctgttacttctcctcctgcgaggtaagctcccgcacattcaaaaaacatcgcaataaaaattgcttgttttgctgtaatagtacctgaacctactgatgtccccatggcatttgctacatcattagcacccacaccaaatgccatcaaaaaaccgaaaacggcggtaataataacaagtatagttccgtattcttgtaaaatttccatagttgatcactcctatgtatttatcgttatgaacgagctaacattaattcaattcgtgaacccacacgttgtgcttgatcagctaaaaccccaatccatgctaaagtttcatataaaaacatcacatcaataggactgtactgattttctatgtttcggagcatcatgcgaagtttgatttgcatatgatctgtatcatcttcaatggcatccaactcatggattaggttattgacgagagtcagttcatgtcctttaaatccggtttccaataacgcatccatttcctcaatcacacgatttgcttgaactgtcgcatctaaactacgataaacatatttcataaaatcctcttgcatttcttgaggaaaggtaaattggcgaccgagcattctcccagctatatctttggcacaattcgctaatttatcttgttgagttgtcaactctaataaatctgtacgatcaattggcataaaaagacctaaagggagcttcaagcgaatttcacgtttcagtgtgtcggcttgacgttcaagttctgagagctcagcacggatctttgtggcattatgccaatctccggcaaaggtactttcaaagaaaggaatgagtagtttacaacattcagttactttatcagaatgacgctgtaatggcgttagaggtgaatgggcaaataatcctagaatattattcattgccatatgaattaaactccttagtggatttgataaaaaattcaggcgcatattaccttatgcgaacagaaaaatatagaaatttcatcgaaaaaaataggtttttagtagataatacaggcacgcatttcttagtaaggaaaggaaaatgaccaaggaaatagagcttaaattgagtgtatcaaatgcctttgctcaatttttaagtcaagaaatgacaagttttcatgtgttaaaacaagagaaggtttttttaggcaatacctattatgatacagcggacagttattttgctcggcacaaaatgggcttgcgtgttcgtcaatataataatgattttactttaaccttgaaaacaaacggtgatgtgctgggtgggttacattctcgccctgaatacaatgtatctcaagaaagtgcggtgccaaatttggcgaaattaacagaaatatatgacttaccgaattggcatgaatttgtcttacagcctattttcagcactgattttgagcgttgtttatggttggtagaatgcgggtatgatgtggaaattgaagtggctttagatcaaggctggattattgcaggagaaaaatccgttcctatttgtgaagtggaatttgaattaaagcagggaaaaacagaggatttgttaaattttgtggcaaatttatctttagaaagtgatgttcgcttaagttcagccagcaaggcacagcgaggttaccaattggcatttaatatacaacctcaagttcaggattggatcgcaaaatggcgtgagtttattgtcttagcaacacatgaaaagatcgcttatttagtaaaatttgaacagcaattaatcgaagaaagtgtgatgctgggaaaagattattttgcacaagaatttttgcgtacagtggagcgaatcggtgcattttttaatctatatcacttttatagtgagaacgtaacgttattggaaaatcaagtaaatcttcaattgacgcaaggcattactcatttggatcagaatttgcttgctgatcttgttgaacgtaatgcttatttattgttgcaaattaaagacattattcggtgtcatagtgaaaataaaaataatgcacttgcgattgaaaaattatttgcattatttcatagcggtcagtatgtcaaacgtatgttagatttaacgtttttaacactttaaggatacagcatggcaaaatcacccaaaacagcctacgtgtgtaatgactgcggtgcggagtttgcccgttggcaaggacagtgttctgcatgtaaagcatggaatacgattagcgaagtgcggttagtttctacagcaaaagtgaaaaatgatcgttttagcggatatgcaggagaaacgaaagccaaaattcaaactttagctgaaatcagtttgcaagaaacgcctcgttttaccagtggttttagagaattagatcgtgtattggggggcggaattgtgccgggtagtgcgattttaatcggtgggcatcccggtgcaggaaaaagtaccctactgttacaagtgatgtgcggacttgctcaaagtatgaccgcactttatatcacgggcgaagaaagccttcaacaagttgctatgcgagctaatcgtttaggattgccaacggatcgtttgcaactcctatctgaaacttccattgaacaaatttgtcatcttgctgatcaactaaagccgcaaattatcgttattgactctattcaggtaatgcatttatctgatattcaatcttcccccggaagtgtagctcaagtgcgtgaatgtgcggcatttttgacccgttatgctaagacaaggcaagttgccattatcatggtcggtcatgtaacgaaagacggaacgttggcaggaccaaaggtattagaacatgcaattgatgcatctttattgttagaaggcgaatccgattcacgctatcgcactttgcgtagtcataagaatcgttttggtgcggtgaatgaattgggtgtttttgcgatgacagagcaaggtttgagagaggttaaaaatccttctgcgatttttttaagtcgtggtgatgaacaaacgtcaggaagttccgtgatggtagtatgggaaggaactcgtcctttattagttgaaattcaagcacttgttgatcattccatgttagccaatccaaggcgtgttgcagtaggtttagaacataatcgattagcattgcttttagcggtattacatcgtcatggcggtttacaaatgtccgatcaagatatttttgttaatgttgttggcggggtaaaagtaacggaaaccagtgccgatcttgccttattgctggcattaatttccagctttcgtaatcgacctttgccacaagatttagtcgtgttcggcgaggtaggtttagcgggggaaattcgccctgtaccaagtggacaggaacgtattagtgaagcagcaaagcacggttttaagcgagctattgttccctttgcaaataaaccgaaaagtgcggtcgaaaatatgcaagtttttacagtcaagaaattagcggatgcgttggcgatattagataatttttaacaaaattgccggataaaaacgaataaatatctaaaaaatagtgtaaaattagacaaaaataaatattttatgcggaatttctatataaaaagggatgaataatggaaaagaagattaaatcacttgatagtattgatataaaaattcttaatgaattacaacgcaacggaaaaatttctaatattgatttatccaaaaaagtgggattatcgccgacgccttgtttggagcgggtaaaacgtttagaacgccaaggcattattatggggtatcgtgctttattaaaccctgaattattggattcgcctttgttggttattgtggaaattacattagttcgtggtcgtcccgacgtgtttgaggaatttaatgtggcagtgcaacaattagatgaaattcaggaatgtcacttggtttccggagattttgattatttgttgaaaactcgtgtagcggatatggcagcgtatcgcaaattgctcggcacaactttattacgtttaccgggggtaaatgacacccggacttatgtagtgatggaagaagttaaacaaactaattttttacaattgaaataagatgattaaacgtattaaacaattttttttaccgaaaagggatttagtcgagtttttattaattctcaccgcactttggggcttttatttgatcgttgcttggtttagctatagcccgtttgataattcgtgggcgatatcttcttttcaaacggaaactattaataaagcaggtgcattgggtgcttggatgattgatctgtttttcacgttttttggcgtggtaggtaatatcataccttttgtactatttatcgcacctatttattttttacatactaagcgaactcaggggttaacttggggaagattttttcttcggatattgggttttgtgacattgctggttggcttaatgatcttggctactttaatgttggcaaaaactgaacatcatttatcgggcggtgtattaggtgctattttaatcgttaagttatatccgctattttctaaccaatttcccttaattattattggtagcattgcttctataatcggttttattttctgttcgggggcatctttattttatttaatgatgaattgttacgactggctgacaatgaaagataaagaatctctattggatacacaatcgaatggtgctgattcagttgaacaggaattggaagaaattatcatacaatcgccacctatagaacaaaatatcgccaatgaagatactgaaaaacaaggacttgagttagtgaatattagtagttttattaatattcaagggttacctgatgaacaagtggaagaacagcaaaatttagcagctccgatgttgatgaagcaaaatgaagtggttgatattgctcaaacactaggcgatttaaagcaacaagaattgcctattccaagcgtttcattgtcaacagaaaaaaatgaagcgttagctttggaaacagcaaatattgcagaaccgaccgcactttctgccgttgaggaagctgacaatcacaatataaatgaacttgccaaacaatttgctgaatttgagcaacaacgtttattgaaaatggaacaacaggcaagagaaatcggagcagaggatgcgttaaaagtgattttagctgaagaagttactgaagacgtgccggcggttatggaagaagttattgaagaaaaagaactcagtcaaagtgcggttaattataagacttatggcgatagtttgattcaccccgcattacagcagaaagtgactgttcaggaaaaaccgacaacaccattgccaagtttagatttacttgaacgccgaacgatccaaacttataacattacccaagaggaaattttagaaacatctcaacgtattatgcaacagttacgtaattttaatgtaaaagcggaagtgcgtgatgtactcgttggtcctgtggtaacacgttatgaattagaattacagccgggagtaaaagcttcaaaagtgacaagtattgatactgatttggcaagggctttaatgtttcgttcaattcgtattgccgaagtgattccgggaaaaccttatattggaattgaaacaccgaatatacagcgtcaaattgtacctttgcgtgatgtattggatacggatgagtttcggcaatcaaattatttattaccaatggcgttaggcaaggatattagcggtaagcctgtgattgtagatttagcgaaaatgccacatttattagttgcaggatctaccggttcgggtaagtctgtcggtgtgaataccatgattttaagtttacttttccgtgttaaaccggaagaggttaaatttattatgattgatcctaaagtagtggaattatctgtctataacggcattcctcatttacttacggaggttgttacggatatgaaaaaagcagctaatgccttgcgttggtgtgttgacgaaatggaacgtcgctaccaattgttatcagccttaagagtgcgtaatattgaaggatataacgaaaaaattacagaatatgaagcgttaaatatgccaattccaaatccactttggagaccgggtgatacgatggacactttacccccaccattggaaaaattaagttatatcgtacttattgttgatgaatttgcagacttaatgatggttgcgggtaaacaggttgaagaacttattgctcgtctagcacaaaaagcacgagctattggtattcatctgattttggctacacaacgtccatcagtagatgtgattactggtttaattaaagccaatattccaagtcgtattgcttttactgtagcgagtaaaattgattcaagaaccattttggatcaaggtggtgcagaggcattattaggacgtggtgatatgctgtattctgcacaaggatcatctgagttgttacgtgtacatggtgcttttatgagcgatgatgaagttgtacgtgttgctgatgattggcgtgctagaggcaaaccgagttatattgaaggtattttggacagtgtgaatgacgaaagtaatgataatgaaactgactatgacagcaatggtgatctggatgatctatttgatgaagttgtggaatttgtcataaacaccggcatcacatcggcatcttcagttcaacgtcgtttccgtgttggatttaatcgagctgctcgtatcatggatcaactggaagaacaaggtatcgtttctccgctacaaaatggtaagcgggaagtattagcgaggaaaggggattactaaattaacattgcgatataatttgtgcaaaaaaccaccgcacttaattagtgcggtggttttttctttgggtgtagcaagttggctaaattaccactgataccccacaccaaccgaaccgccgacatcgcccgttgaactgcgagtaccttgcaatcgtagcgttattttaccattatcacttactcgtgaataacctaacgccagtgcattttgtcctttaaatgttccggcagatgccgcaaacatggatttacccggcacagaagacatcggcaacccagccgccgccaacgctcctgcaattcctgcacgtaaatttcggtcagtagtattcaattgtgtccgcagttcattgtctttggtgtccacatagtttttattagcaattgccatacctgaactggaagtgttcaaatcggaaaccaatgcttcacctttggcatttatgctgattaccgatttttcacccagtcttaacgcacgagacttgccgtctaaattcagtcctaacttatcattttcatagaacgccaagcgattttcgtttaattgggatcgctcttttgtacttgtgttttccacattcaacccattgctatccaagcgagattttttgccattgatttcacgggtttcaaaagaggtcatgtttttcaattggtcggacagtttgacttctaagcctttaccgtcttgagacatttccactttgatattaccggcagcggtgcggtcgctgttaaatttattgccattcgcaccttcttcacctttaatcgccaaagtaccgcttaatgctgtgcgaatttccatgtcatcattgcctttaaatttcaagcccgatttcgccaccgcctgcaaatcaccgattgttgccacgttggttaactctgcggaactatcaggtttcactaactctacaactttctcatagcctttgtaattttgttcataggcttcctccgcttttgttaagcctgtttgagcttcttttaaatcatttcttgcttgttcaagtgcttttttcgcttcatcaagtttcatttgattttctttgagcttggcttctgcttgtgttttatcattgccttctggcaacgcatttattgcttgttctaagctacttaccgctaatgctaaatccgtgaaagtttgtgctttgtccgaaagtgctttagcttccttgctcactgctttcactttttcctcaacagctttggtgagttcagccgatttttcttgagtctttttcttctcttcttcggtttgtgcttctagcccaagaccactcgccacattgctaatcccaataggtgcggtgcttggttcggctttgatcacgacttgtttcttctcttcctcagaaatatcttgaagtgtgccgtcttttaattttttgaaactaccatctgcccctttcacgactttttcattgcctagataaaaatcaaatggacggttattgttcagatttttaacctgttcatcgacatagtttttatttaccgcactagtgccgtcagctccattttctaaatcttttagaccggtgatttttcctgagccgatttttttaccgtcagtctcttttgtcgagaacgtaatagacggttcttgacctttctcaaacgattctagactgtctttatttaccggttttgcccctgctttaatagtgattgatgctgtatcagcaaatggatttgctccatttgctccgcctgtgttattcgccccttgtggcataagtgcaataccctctttattgatattcactttcgcacccgttgtgccaacttggaatgtggcattttctgaagttaaagaaagtttggtgacttcttcatttgaaccagcaccatttccgcccgcacttcctttaggtgaagagatagattttatattttctaacgtgtcagtcgtcgctatagtaacaacagccgtagtaggtgcggttggtgtaccagtcgttgttgtactcgtggttggtgttgtagttgtgctacttgccgaagcagacggcggtgcagctgctggagcaggcgacggtgctggagcagctggtgttggagccggtgcagaagcagaagcactcgaacttggctgtgttgcactgccatttccatttgctacagtaacttggatattctgtccgttcgtaaacttcaaagtgtcgccacgaccgatttcgataggcttaccactaccattttcaaccttgaacttaaatttatttaacgcttgttcaaggtatcctttggtaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcaatcacgctatacacctgtccgccgttaatcgcatcggttgagttaggcattacacttccagcagcaacatgtttaattatgcgttcattgccttgactacccacactgacaacttctttatccgcccctgctcctgcattgttccagtcaaatttcaaacttgctgaacccacattaatatctgcactggtcgcagcggtagttttcccttcccatgtagaatttttacccaacgcaaaggaattatcgccgttggtagacccattgccgacattgattatcgctaatttattggttactttatccgtcaaagaaaatgtaatttctttaccgctaccatttgaagaagccttgctggtcaaatacgttccctcgcccttaatcgtgattttatcgccgagtgaggctttaacgtcagtgccagtattccctgcaaaggtcaagcctttttgaacaatcgctttagcgacttcggacaggtctttcacattgacggcgttgttggcaattgtcgtgctactgccaccgctgtttgtgctatcaagagttccagcaaggactttgtcgataatgtcagcatttccgtttccgctacttccaccagcaccatttaactctaaaccgctcgctaagttagtgagttttttgctatttaaatctaaaccgctgtcactaaaggtatagcttgctttattggtacccactttaatggaggcacctgcattgtctacgacaatgcttgaaccgtctttcgtgctttctaaggtagctttaccgtcctcaagtttcaacgcacctttgccatctgctttattaatttcagacacgccactgaatttaccatcggctagggtaacctctgaactacctgccttgaaagtaattttgttatcacttccattacttccacccaaagcaattttcgccttctcgccattggcaatagacgcaatacctgttaagtttttagacaatttaatttctagggtatctgctttgccatttgtaccgtttttcttcgccacgataatattatcaggtgcggttgtaatttgagttgttgcagttgttcctgctgctgaaattgctgtttctccaactattttcaacgtctctcccagttttctggtaacatcttgattgtcatttccttggaacttcaagcctttttccacaagggctttcgccacttcggataagtcttttacattgatggcattgttggaaattttgttgccgttgttattacctttatcaggatcgccagcaagaacgttggcaataactgtactattatttccggcacttccaccactaccgctagtatctgtcaatcctaaaccgctcgcaagtgcggtaatttgtttattaccgacatggaatccttttggatcaaaggtatattttgccccatttgagagaatgacaacattggtattcgcattgttgcctttaccattttcattaaacttaatttcagtttttactttaacgtttccgctaccgccattggcgacttctttgccagcaatcgaagtaatattagttaatgcctcattgacattaaacttaacaacaccgttactttccactacagcggtggtgtttgtgccatttttaaaattcaaaccctcgcttaatttgacggtataatcacccgaactattcgccttgtatttaatgacttggtcggtaatttttccctctatattggtttttatggttgcaatatattgctcgtttttatccgctttagtagccgtttcattaattttttgcgtgattttctcatctagcccaattttgatcgtatcgttactctcaacagaggttttaatttgattagcagtgcctttcactttcaatttgccatcttttaatgaaattttcttttcaccaccactgtctgtttcaaattttaagtctgagctgaaatttttaaattgatcatctacatattttttagtggtcaaagtcatttcaggacttttatcagtaacattttcagttactgtgactttttcaaaacgtggatcttttttaattccaattcggaatactccttgatccttaccgtaattcgtcttaatgttgtcgctggcaaaatcaccgccgtcaataacaccggattgtattgttattttttctccaaaatatcttgtaccttcagttgttccatcactaaaaataaaacctttattaattttagcaatattatcatctatcgcttgtttaaatgtttttgctgtagctggtgttgaagcagtggctccgttagaacctattaattgattgaatgttgatttcgtaaatccacctgaatttactgtcgcacccaatacagttgttgctaactcttttaattgtccaaagttggcagcatcggtgtcggctgttccttttgctaactgggtaatttttttgttgcctaagtccaagccatctctttttaatgttatcgttgaaccgctttttgacgagagtttaagaccatcactgttcgtaaagtcaattttattgccactattgccatttttaccggcaatagaagaaatacctgttaaagtgtctttaagcgatatggtaaccgcactaccgctagcgtttgtcttgatattgccattatctcctttaatatccagtttgctagttactttaaaggttccgttatccccatttacattaaaactggtagcaacatttttgaatttatcatcaacgtattttttgttgacggcatgcttgtcatctgtagggttaccggtaagttttacagtcttaaattcaggatcatcttttaagccgatagtgaatgtcggttttgaattatcatttttaaattctgtttttaggtttttacctagatgtgtttttgaattgcctgattgaatatctccagctttaattacaatagttgaacccaaataaaaaggtgtagttggctgattcgttccatcactaaatttatatccttgatttatagccttaatcgtttcgtccaatgcatccttaaatgtatgtgttgcacctttcttactttctggtgtactaatatattctacggcagtaaaattaggggtagtaaattttgttttatcagtgttaacactcaaccctaagatactaccaccaagctgattcagctgattccccgtaatcgcttgatcggagtttggttcaattttgccgtcttttaaattgccgaattggattttgttaccaagatcttttgttcctattttttcatcgaagccttttgctccgactaatactttgtcctcggaaattgccggagaatttgctaacggttcgccggttcgggtatcgactttgtagaatttgttgtcgccagccgattttaccagcttcactttcttgccgttttcttcggtgtagtaaacaacaagtccttcttttttaacataatataacgctcttagttgtcctacagtggcgacatcactatccaatgcccccggtgcgacattcactattctacgcaatccaacatgatttttatttcctttagatgaaccgggaccgccctttgcatcttttgtcgtatcccaacccccaacggaaataacccctgccgatgtatccgtttcaattctataactggaaccttccggtacatatccttctaaactggaggcattgtaggcatttttttcatttaaactggctgttgttttatctgaaccagtataaaagtaattcgtcgttgatctatatcctaaagcgactgaattttcggatgatgagcttgaattattccccaatgcgactgagtttttagcattttcattaatcttagaatcatttcccagtgccatagatgattctgaaaaagcagatgaaccatatcctatggcaattgaattatctttcttaaccccaactccggagcctatcccaattgaaccagctcctaatattgttgtaccggttccgatagcaaccgagttttctttatgtacgtttgttccaatacctatggctattgtattggttgcatatttcccaacattatttaacgcccctaagacgaccgaattagctcccctgacataagaggcactacctatggctatggtattatctccattatttgaaatgtgataacccaaggatattgcatgatttccttgttgtctcgttttctttatgtcttctgttgtggtgatttctaccttactttctttttcatattcaaatttatttgctttttcaagtttagttatcaactcgcttactttattattcccattaaaatgattggcaggaaatccatacttaacaatttcattgttatctcccactttaagatcattaatatcagtagttacagttttaaaatgaggatcttgattttcattgacagtaccaagcttggtttcttgcataatttgagttctgaatttctcagctgacatatcagttaattttgcattcgacgatacattaggacctatcgctattgaacccattcccactgcttttgctccggaaccaaaggataatgatccttctgcggttgattcagccgcatttcctatggcataagaatttttcgcaaaaacccttgatgagtctcctattgctgttgctccgtcagcccctaaaccgacaaacgcacgaacaccgaccgccgttgatctatcagctaatgcaaatgataatgtccccatagccagtgaagcatttccatatccaactgatcttgaccctattgcgattgcccccactccggctgcataggttggggaatacattctatggtcttttccgtcatctgctttaacatattttttgtaaaaatcattccaatttaatatactgttatacgtaacgttactagatgctctacttccactatatccataaatttgtttgattgtcgcttcaggtaatctatctgcaaatccgccttcaccggctttaagatttggttctccatagttaactttgttcccattttcaaatatatcatctcctcctattgcgatagatgccccaccagccgccatgacgtccgcacctaaggctgtcccttgtgctactgcataaacattattccctattgctgttgcttgtgcaccttgagccttactttcagctcctaatgcagttccattggttcctgctactatagattcgtatcctacggctgttgctccatctcgaagtgcttgagctccgtatcctacagcaaccagtccttctcctgttgctttagttttatctcctgctcctattactacaactttttccaacttggtgttttgtccatttactttatgtagattttctttccctaacacaatattaccattattatttttttctccatattcattttgccaatttgctatacctacagttcctttactgctatcaatagctaaccaagcagcatttgatatagtactcaccccaaaaaatcccgcaattaccaacaccaacggtaaaaccttaaacgttcgtaaaaccccaccgcactttggtttctccgaactgctcgccacgtggcggttgcttgccaactctgaaacggctttacattgacctgttgtaatatcgtatttggttttaaatattttgttcatagaattactcgctttaaaaattatctttgaatgacttgttaaatggttattgatcgaatctgttattgattgtttatttattatctcttactgattatttattaaactttagagagaggggataaccctaaataggcaataccttgctttttaaggcatagcagaaaaaggcgaatgatattttcgccgagggttttaaaaggggaaattttggtatgacgagaagttaaaaattttttaaaatttattttgcaaggtttataaaaaggcgttagcctaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcatattgttttcgtctatcaaatggttaagtaataaatttgggcgattttatcccaaatttattagtaagggaatgatttcgtgtattttatttgtattttacacttgttgttgattgtttacgatttgcaaccatgatttccacaacaaccgtgatgttcatggtgttcatgatgatgtccgccacatccgcaatgatgaccctcttcatcattatcatgtgcacaacaaccgccctctgtatgaatatgaccatgtgccatttcttccagtgttgcttcacgcgttgcaatgacctctacggaaaaatgcaattcttgaccggcaagcatatggttaccatcaactaccacctcattttcatttacttcagtgataacaacaggtaatggcccaagatccgtatctgcgataaaacgcataccgactaccagctcatcaacgcccacaaaaatatctttgggtacacgttgcaccatgttttcattatattctccgtacccttcttccggttttacacgcacttcgaatttatcaccgacagatttaccttccagtgcattctccagcccgatcacgaggttctgatgtccatgtaaatattctaaaggttgatttgccggtgcttcatcaaccaatacgccgtcttcagtgcgtacttggtaagcgatacttaccacaacatttttttctactttcatttttattcctttatgctataaaaatgcggtcattttagccaaaatattggctattgtcattcatcttcatttggatattcgtcaaaaaattctccgtcattaccatattcatcttctgttgcattcggatcttcgaagtaagtaccccatccgtcataaatgccaccgaattttgtgattaatggcaataagtctttttgttgtgcatcaatgatttctgcttttaaattaacttcactaatgatgtcaaagcagaaaattgatttaccttgttcatcttcaaattcttccgcttcagaaacttcatagcctgctttgaaagcatcaacggcgattttttctaacttatcaaaatcgtcatgtgcgatatgatgttcaataatatataaagcatcaggatcactaccgtcattgagtaaatcagtaataatttttctagtttcttcttggagatctacaagtgcagtcatattttttcctttatgtttatttagggagtggggataaattcattgcgttgatataatttaattgtcgccatgcttcatagacggtaaccgcaacagcattggataaattcatgctacggctattttctatcattggaatacgaattttttgtgttgtcggtaagttatctaaaattggcattgggatacctctagtttccggaccgaacataagataatcgcccaactcaaaatttacttggctatgtgcaggtgtaccttttgttgtgagtgcaaaaagacggttaggttgttctgtgtttagaaattcattaaaagttttatgctttttgatttgtgcaaattcatgataatccaaacctgaacgacgtaattttttatcgtcccaagtaaatcctaaaggttcgattaaatgtaaacgaaaacccgtattggcacataggcgaataatatttcccgtattttggggaatttccggttcatacagtacgatgtctaacataacaaaatcctcgtttatgcaacatggggaattttactcttttatcaactaatcacaaaattattcctaccgattccttcaaaaaatacttctaagcaaacagaaagtgcggtctaaatgtgcataaaaaaggcggagaactctccgcctttcatgatggaaaatatattattaagctttaggacctgccgcaataagtgcttttccttcttcatttgtagcatatttttcaaagtttttcacgaaacgacttgcaaggtcttccgcttttgcttgccattgtgctttatccgcataagtatcacgaggatctaagattgcaggatcaacacctggtaatgcttttggaatggctaaatcgaagattggtaatgatcccatttccgcactttcaattgagccgtctaagatagcgtcgataatgccacgagtatctttaattgagatgcgtttacctgtaccgttccaacctgtattgactaagtacgcttcagcaccagaatctttcatacgttttaccaacacttctgcatattgggttgggtgcaaacttaagaatgccgcaccgaaacaggcggagaatgttggcgtcggctcagtaatgccacgctctgtaccggctaattttgcagtgaaaccggataagaagtagtatttagtttgttcaggtgtgagttttgaaaccggaggtaagacaccgaacgcatctgccgttaagaagataacttttgttgcatgtcctgcttttgataccggtttaacaatattgtcaatgtggtaaattggataagatacacgagtattctccgtttttgaaccgtcatcaaagtcaacggaaccatcctcacgaacgacaacattttctaacaacgcatcacgtctgattgcacgataaatatcaggctcgctttctgcggaaagtttgattgtttttgcataacaaccaccttcatagttgaagacaccgtcatcatcccagccatgttcatcatcaccgattaattgacgtttcggatcggttgaaagcgttgttttacctgtaccggataggccgaagaaaatcgccacatcgccatctttgcctacgtttgcagaacagtgcattgaggcgataccttttaatggtaagaagtagttcatcattgagaacatcccttttttcatttcaccgccgtaccaagtaccgccgattaattgaacgccctcagtaatgttaaatgccacaaagttctctgaatttaatccttgctctttccaattcgggttagttactttagaaccgttcataaccgtaaagtccggtttgaaattttgcaattcttcatcagacggacgaataaacatattttttacaaaatgtgcctgccatgcgacttcagtaacaatacgcactgctaaacgtgtatcagggtttgctccgcaaaaagcgtcgataacaaacaaacgcttgccggaaagctgtttggtgaccaaccctttcaaactttgccaagtttcttggttcatcggcttattgtcgtttttcgccgcatcgctcgtccaccatactgtattttttgttttttcatctaaaacaatgtacttatcttttggcgaacgaccggtaaaaattcccgtatctaccgcaaccgcacctgaagtggtaacaacacctttctcgaagcccgctaaacccggtttggtttcttcttcaaaaagttgttcataactcggattatggacaatctcttttacatcatagatgcctaattcacctaattcatttattactttgtttaagtcagtcataaaacacctcatagttaaaagttaattttaaaagttaatcatttagtggtagatattatagtgaaaataagaaataaaaaatgttatcttgatctcaaaattgaaaaataaatgaaatgaatgttgagaattataaaaagcgatggttgaaccatcgctttgaattaagattaatatgattatggataaacaggaagacgtttgcaaattgctaatactttttctttagtatcagcaatgacttgttcatggttatctttattcatactgtctaaaatatcgcacatccaaccggcaagttccgccacatcttcttcgttgaagcctcgacgagttacagcaggtgttcccacacgaatacctgaggtaacgaacggtttttgcggatcattaggaaccgcatttttattaacagtaatattggcacgacttaacgccgcatcagccgctttaccggttaagccatgattgactaaatcaactaagaataaatggttttctgtaccgttagagacaacgttgtaaccacgttgtttaaaaacttttaccatagcttttgcattttttactacttgtgcttgataagttttgaactcaggttccaaagcttctttaaaacaaacggctttcgctgcaataacatgaactaacggtccgccttgtcctgccggaaataccgcactatttaattttttgtaaagttcttcattgccgttggcaagaattaaccctccacgaggtcccgctaaggttttgtgtgttgtggtggtaactacatgagcatgtggcattgggcttggatatacaccggcggcaataagccctgcaacatgtgccatatcaacaaataaatatgcacctacttcatcggcaatttcacgcatttttgcccagtcaacgatttgagaataggcagaaaatccgccgacgatcatttttggtttcacttcatgagcctgtttacgcaacgcatcatagtcaatcagtccttcggatgtaataccgtattgctccgctttataaattttaccggagaaactgaccgaggcaccgtgagttaaatgtcccccatgagcaaggctcattcctaaaatggtgtcccccggatttaataatgccatataaaccgccgcatttgcttgtgagccggagtgcggttgaacgttagcataatctgcaccgaacaacgctttagcccgatcaatcgctaattgttcaacaatatctgcatattcacaaccgccataataacgtttacccggatagccttctgcatatttattggtgaattgacaaccttgtgcttccattactcgtgggctggcatagttttctgaggcaattagctcaatatgctcttcttgacgaagattttcatcttgaatggcttgccataaaaccggatcgtaatcggcaatattcatacttctttttaacattatgttttcctctttgctcacttatgaaatggtaacagtttacctgttttaacttaaaaatttaattaaaaattaattcctatttttcatcggtgtaatgaaaaaatttcattcataaataccgataagattgaccgcacttttattgattttctcttgctacggcacgataaccaatatcttgccgataaaaacgtccgctccattggatttgtttcgccaattttagtgcttgctgttgtgcggcaaaaacattttcacccatcgctgttacacaaagcacacgccctccattcgtcaataatcgctctcctttttgctcaactccggctaaaaaaactttttgattttcacccgcacttattggcaagccttgaatttcatcgcctttgcgatagttattcggatagccttctgcggctaaaacaataccaagtgccgcttgctcagaccattcagatttcacttgatccaatttaccctcgcaggcatttaaacaaagctcaaccaaatcagaccgcatacgcatcataaccggttgggtttcagggtcgccaaaacgacagttaaattcaattactttaggctgtccgtgtttatcaatcattaaaccggcatataagaaacctgtataaatattgccttctttcgccatgccattcacggtaggataaatgatctgttgcataattcgcgtatgaatttccggtgtcactacaggtgccggagaatacgctcccattccccctgtattcggaccagtatcattttcgccaacacgtttatgatcttgtgaagtcgccatcggctctacatttttaccgtctaccataacaataaaactggcttcttcaccctctaaaaattcctcaatcactactttgctaccagctttgccaaaagcattaccggaaagcatatcttgaatagctttttccgcctcagccaacgtcattgcaacaatcacacctttgcctgtagccaaaccgtctgctttaacaacaatcggtgcatctttttcacgcacataagcaatcgctttttctgcatcagtaaaactgcggtattcagcagtaggaatatgatggcgagcaagaaaatctttcgtaaatgcctttgagccttctaattgagccgccgcttgagttggaccaaagatttttaaccctgatgctcgaaaagcatcgaccacaccaagcactaaaggtgcttcaggtcccacgatagtcaagccaatttgattttcttgtgcaaagttgaccagtgcatcaatatcagtagcggaaatagctacattttccaccgcacattttccgtctgtttccatagctgtccccgcattgccgggtgcaacaaatattttgcttgctaaaggtgattgtgcgactttccacaccaaagcatgttcacgtccaccatttccgataattaaaatattcattgtttttccttccttaactgttttttaggaataaagaaagcgggaggcgtattttccttaatatttaaataccctgaatctcccgttagaattgaatgattaattgtaccatccctacaatcagatatatccatatcataactcatgatgttaattaaaaatgtagccagttgctgatgaaacatttttttacaagatgaaaaatggttatgaaaaatatcttgtaaaaacttattttcagaataaataaaaataggcactaaataattagcttcatttaatgttccttgattatatacttcattagaaacaaactgtccgtgatcggaagtataaattaaaacccaatcttcaggttttaaagatgttttaagataattaaacactttttcaattaatttatccgtattatatatagtactatcatatttatctaaaggggtgttctctttgaaaactttttcttgctcagataaataataagcatagggtgtatgagatcctctttggtgtaaaacaacgaagtgcttcttacccccccccacctcacttaaatctatattttccagtaatggaaataagttatgatcatgcattccttcagaagatttatacccaaggctattaggaaaacgcaaatcatcgacccacgttttacccataagactcataatcatcatttgattttcaggttgtgaagaatagaaatatgtttcatatccctgctctttagctaagcggaataagttagttcttccgctaacaatttgttctaacccatttggttttggaatggcattaaacaatgatgggagagaaatagcagtccttgagcctgctgaatatgcaggttttaataatgtttcagtaggaaaattttttgataaagatgttaagaatggggtggtttctctctcataccccaatgcacttacattatttgcacttacactttctcccataatccaaataatattaggtatttggaatgagaatttaggtttcggcttcggcttatctttgtaataaaccgatacgttgctcaaattaaataaatcatagggtaaagttctacctataaaatatccaaaagaaaaataatttgctttaattcttgagtagcccggattggaagtaattcccagttcttgatcagaataaaaactacgaataaaaatataagccatacttaataggaataaaatatctgcaattaaatatgttttttttctaaatcttgaaatagaagaaaaaataagaatatcaaaaacaccccaaattatccctccggatattttatccaacatatgaataccggcatttgtaacttcccaatattctttaaacattaataaataatttgtaccattaatccagctttgatagacctcataatgaacattattaactaacgtactacaagaaaaaaataacaaaataataaaacgagttatcttatattttgagaaataaaataatgaaattaaaataaatattattagaaaactctcactaattttgtataaactatttattccaaaaaaatagcgataaagtatttcactaattaataaaacagcagaataactcaacaaaacaatgatatttttcatgaaaatccttatttattaatgtctaaaatgacgcattttagtgagtaccattaccatattatgctcattggcggcatcgataacttcttgatcacgcattgaaccgcctggatggattacgcattcaataccaacttttgcggctgcatcaatgccatcacggaacggaaagaaagcatccgatgccattacacagccttttacttccaaaccttcatcttttgctttgatccctgcaattttcgctgaataaacacggctcatttgtccggcaccaatccctacagtttgattatttttagcgtatacaatagcgttggatttcacaaattttgccactttccaacagaataaaagatcttccaactcttgtttggtcggttgacgtttactgactacttcaagatctgctaaatccaccatagataaatcagcctcttgtaccaacaaaccgccattgacacgtttaaaatccaagcgttgtattgcactttcccaattgccacacatcaataagcgaacatttttcttacttttcacaatttcttgggcggcggaactgacggtcggtgcaatgatcacttcaacgaattgccgctcaataatggcttttgccgtgtcttcatctaactcacgattaaatgcaataattccaccgaaagctgaggttggatccgtttggtaagctcgattataggcttcgagaatatccttgcccagtgctacaccgcaagggttagcatgcttaacaataacacaagccggctcggaaaaagatttcacacattcaagtgcggcatcagtgtcggcaatattattataagaaagtgctttaccttgtaactgtttagcggttgagacacttgcttcttttacgtcttgttctacatagaatgctgctttttgatgaccgttttcaccataacgcatagattgtttacgtataaaattaagatttaaagttcgtggaaattgaccgcacttcgcttcagcttcttcttcagctctgaaataaggttttaccatttgtccgaaataattggcgatcatgctgtcatattgtgcggtatgttcaaacgctttaatggctaaatcaaatcttgtctctaatgttaaactatttcgattttgatccatttcagcaagaattgcattaaaatcgctattattgactacaatagccacatgttgatgattttttgcggcagaacgtaccattgtcggaccgccaatatcaatgttttctactgcatcttcaagtgtgcaatcaggttttgctacagttgccgcaaaaggatataagttcactacaaccatatcaatagcatcaatttgatgttgcatcataacttcatcatctataccacggcgacctaaaatgcccccatgaattttaggatgcaaggtttttacacgtccctccatcatttcaggaaaacctgtataatcagatacttccgtaacaggaatcccgttttcagcgagtaattttgccgtcccccctgttgataatagttttacacctcgtctaactaaaccttgtgcaaattcaacaattcctgatttatctgaaacgctgagtaatgcttgacgaataggatgatttaattgcattgaatatttcctttattttaaccgacaaaaaacgcaggcattataacgcaaacgtttgctcttgtgtaaataaaaaagcttataattaagtacagaatgaatacatgtagcggtaaaattatttttccactgctttatatacgcactaaaataccctgacattttttgcaaaaatataccgcacttttttgttgaatgttgtgatgacgacgtgcggacaattgatgggtttgacattgacattgataagtaaacgttttgcctcttacattcgttacatcaaactgatgacacgtatccgccggaagctgaaaaatcttgttcatcacatgttgccattctgagccgtgaggttttacacgcccgaattgttgatacacaattaaatgtgccaactcatgaggaactacttgctgaataaattgttgcggattttccagcaataaagtgcggtttaattttatgctgttttgttgtaaataggcgacccctgctttcattcctcgcacatcataactgactgtcggcatctcaaaattacattgaaaatattgttcagccagtattaagcaatctcttaaacgtctttggatttgcatttttatatgacgaaactcagctaaattttgttcagttttaggcataaagtgcggtcaattttgggtaagatttataaacaaaaggcgaactgttgagttcgcctcatatgagaaattaatcattattttaaacttgcggcagcacgtaattcttctgcacgatccactttttcccaagggaattgtgctcgtccaaaatgaccgtaagccgctgtttgacgataaataggttggattaaatctaacattttgattaaaccataagggcgtaaatcaaaaaattcacgaatcaacccgaccaataattcattggcaactttccctgtaccaaaagtttcgaccatgatggaagtaggttctgctacaccgatagcataagaaagttgaatttcacaacgatctgccaatccggcagcgacaatatttttcgcaacataacgtgctgcataggccgccgaacgatccacttttgacggatctttacctgaaaatgcaccgcccccgtgtcttgccgctccaccgtaagtatctacaataattttacgtccagttaaaccgcaatctcccattggaccgccaataacaaaacgaccggttgggttgataaaatatttcgtctcttttgataaccattctgccggtaaaatcggtttaataatttcttccattaccccttcgtgaacagttttttgatcaacattatcagaatgctgagtggaaaggacaactgcgtcaattccgacgattctattatcttcgtatttcaacgtaacctgacttttggcatcgggacgcaaccaatctaatataccttttttacgcacttgtgcttgacgttccattaagcggtgagcataagtaatagcggcaggcattaaaacgtcggtttcattcgttgcatagccaaacataatcccttgatcaccggcaccttgatctaatggactttcacgatccacgccctgattaatatcagaagattgtttaccaatggcatttaataccgcacatgaatgcccgtcaaagcctatgtccgaatgtttataaccaatatcgcaaattacttgacgtgttaagttctcaatatcaacccaagcagaagttgtaatttcaccgccgactagagccatacctgtttttacataggtttcacaagctactcgagcttttggatcttgtctcaaaatctcatcaagtactgcatcggaaatttgatcggcaattttgtccggatgtccttccgatacagattcggaggtaaataaataagatgacatagattttccttaatggtagaaatttttattaatattttttttagatgttttaacgtctagacggctatattacgcttttttaattaaaaggcaagtcttaatttaggttgtataaagggacagattgtgaaacaatctgcaaattattcggcattgtgcggacaacaatattttcatttcaataatttaacaattctcaaaaaagaaaatatattggttagcacctacttcatgtcaaggttattaaaaattaacaattaattaaggtgaaggagagtgatcgatttcgatggatatcgccctaatgtaggtatcgtgatctgcaatgcagaaaggcaggtgctttgggcgaaaagatatgggcaaaactcttggcagtttccacaaggtggcataaatgacaatgaaactgctgagcaggcgatgtatcgtgaattatatgaagaagccggtttaacaccgaaagatgtcgagattttatatgtttcaaaacactggctacgctataaattaccaaaacgcttacttcgtcatgataaccgaccaatttgtatcggacaaaaacaacgttggtttttattgcaattggtttctgatgaaaaaagaatcaatatgcagcacacaaaatcaccggaatttgatggttggcgttgggtcagtttttggtatccggtgaggcaagttgtcacatttaaaaaagatgtttaccgtaaggtaatgaaagagtttgcattgtttttatttgatacaaacttaaaatctcgattatctgtaccggaagaaaaaaaaatgttttcatcggttaagaaaaaacttattcacaaaaaaaatcataaatattcttcaaatcagtgagggggataaaatgttaaccttttttctcatttgtctaggtgtaggaacctttgcagggtttcttgctggattattcggtattggtggaggactcattattgttcctacgcttgtgtatttacttccgatggttggtgtgccggataatctgctcatgtcaaccgcacttggtacgtctttcgctacaattgtcatcaccagtttttcttcagcacagcgtcattacaaacttggtaatgtagtttgggatgcagttaaaattctcattccaactctgatgttatcaacgtttgtttttaccggtattgtcagtcaattagataagagtttatccagtaaactctttgcagttttagtcgcttatatggcaataagaatggttatttccactaaaattcaaatcaaaaatactaaaaaactcactcctttatcgtcagttattggtggcgttttaattggtattgtgtccagcattgcaggcattggcggtggcggatttatcgtaccgtttttaaattctcggggtgtagatataaagaaagctattggatcttccgcagtttgcggcatgctattagggctatcgggggcactcagttttatgcgtagtggttggggcgttactgaaatgccggaatattcgcttggttatgtctatttacctgctgttttaggcattaccatcacctcattttttacgtcaaaaataggtgcaactacgacatccaaactgcctgtacctacattaaaacgctatttcgcaataatgctttgtgtgattgcacttaatatgctttttaaataaggaaatttaatgaatacattttttcaaatgccctatattgatcctgtcatgtttagcttaggacccgtcagtttacattggtatggtgttatgtatttgctcggttttggttttgcttattggctcggaatggctcgggcgaaaaaatcaaatggagtatggacatcagaacaactggaacaattattatacaatggattttttggcgttattttaggcggaagaatcggtgatgtgttcttttacaacgttgataagttttttgctgatccactctatctatttcgtatttgggaaggtggaatgtctttccacggtggattaatcggcgtcattctcgcaatgatttggacatctcgtcgccaacgtcgctgtttttggcagaccgcagattttgttgctcctttaattcctttcggtttaggcatgggaagaattggtaactttattaacagcgaattatggggaagagtaacagatgtaccttgggcaatcattccttacgcttcaaccgcacctcgacatccatctcaactctatgaagcctttttagaaggtttcattttattaatcatcttaaatttctatattcgcaaaccacgcccaaccggttccgtagcaggattgtttttaatcggctatggtatcttccgtttcctagtggaatatgtacgagaaattgatcacaacgtaaataccattgatgacctcctcactcgagggcaattactctgtttaccaatgatattcggtggacttgccgtgatgatttggtcttattctcgttcaaaggcaaataaaagtgcggttaaaaaagggtaaatttttatgcgtcaatatttaaatttatgtcaacgtattattgatcaaggtcattgggtcgaaaacgaacgcacgggaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatgggaagagtatatggcgtacaaggtcgtcgttggcggaaaccgaacggagaaactgtcgatcagctacgtaaaatcgtcaataacctgagcaaaggaattgatgatcgaggagagattttaacctttttcaatcccggtgaaattgatctgggttgcttacgcccttgcatgcacactcatacattttctttactgggcgatacactttatttaaccagttatcaacgttcatgtgatgttccgctgggactcaatttcaatcaaattcaagtgtttacatttttagcattaatggcacaaattaccggcaaaaaagcgggacaagcctatcataaaattatcaatgcacatatttacgaagatcagtttgaattaatgcgtgatgtacagcttaaaagagagccgtttccgcttcctcgattagaaattaatcctgatattaaaaccttggaagatttagaaacttgggtaacaatggacgacttcaaagtgattggctatcaatgccatgaggcgattaaataccccttctcagtttaaaaaataggaaaaacctcaacagtgcggtctgattttgatgaaaaaatgatgcgttatgccttatctctagcggataaggcggaggcattgggagaaattcctgtcggggcggttttagtggataaacaaggcgatattcttgcagaaggatggaacctatccattattcacaacgatcctaccgcacatgcagagattattgcattacgccaagccggacaaaaattacaaaattatcgtttacttgacacaaccctctatgtcacgctggagccttgtacgatgtgtgccggtgccattttacacagccgaatcgggcgtttagtgttcggtgcttatgactataaaacaggtgcggtcggctcacgctttcatttttttaatgattacaaaatgaaccatatgctggaaattacagggggcgtgttgcaagaagaatgtagccaaaaaataagtacattttttcaaaaacgtagaaaacaaaaaaagcatttaaagcccaactttaaacctttcctttaattcttgtaactgatctctaattgcagccgctttttcaaattctaaatcttgggcaaatttatacatctgttgctcaagttttttcacttgttgttgatagtccttaggcgaatttatcttttgataaagtgcggacgattccgccacagttttagcacgagcctttgttttacttttcgttatagcaccttgcccaatatccagtaattcgcccacttttttatttaaagcctgtggcacaacgcctttttccgcattgtatttcatttgtttttctcgccgacgatgagtttcatcaatcgctttttgcatagatttcgttatgctgtctgcgtataaaatcgcttttccgtttaaatttcgtgccgcacgaccgatagtctgaataagagaacgttcagaacgaagaaacccctctttatcggcatctaaaatcgcaactaaggaaacttccggaatatccaaaccctctcgcagtaagttaatcccaactaatacatcaaattcacctaaacgcaaatcacgaatgatttcaacacgttcaacggtatcaatatctgaatgtaaatagcgaacccgaataccatgttcttccaaataatccgtgagatcttccgccatacgtttggttaacgtggtgaccaaaactcgctcattttgctccgctcttttccttgcttccgataacaaatcatcaacttgaatcgctacaggacgtatctccacttccggatcgagtaaaccggtaggtctcacaacctgatcaataatttcatcgcccgatttttccaattcataaggccccggtgttgccgaaacgtagatagtctgcggtgctaaacgctcaaattcttcaaaacgtaatgggcgattatccaacgccgaaggcaaacgaaaaccgtattccacaagcgtttctttgcgtgaacggtcgccacgatacataccgcctatttgcggaacagtgacatggctttcatcaataattaacaaaccgtcacttggaatataatcaaataacgttggtggcggctccccctcatctcgccctgataaataacgtgagtaattttcaatccccgaacaatatcccaactcattcatcatctcaatatcaaattgagttcgctgagttaatcgttgttcctctacaaggcgattatttgccaacaaatattcacgacgtgcctgaagttccaacttaattttttcaatcgcctctaaaatacgttctcgaggtgtaacataatgcgttttaggataaatagtatagcgaggtatcgcaccaaaattcgctccagtcagtggatcaaataaactcaaacgctcaatttcatcatcaaataactcaatacgtactgcccgatcatcagattcagccggaaaaatatcaataatttctccccgcactctaaatgtccctcgttgaaaaacctgatcattgcgggtgtattgtaattctgccaatttcgccaaaatttggcgttgatcaacaatcgcaccatgttgcaaatgcaacatcattttcaaatagctatccggatcgcctaaaccgtaaatcgcagaaacagaagcgactacaatcgtatctcgtcgctcaagaaaagatttagtcgcagacaaacgcatttgctcaatttgatcattaatcgaagcatctttttcaataaacgtatcactactcggcacataagcttccggctgataataatcataataagacacaaaatattccaccgcattttccggaaaaaaagccttcatttccgcataaagttgagcagccaaagttttattaggagccaacaccatagcaggacgattcaatttcgcaatgacattggcaatcgtaaaggttttacctgatccggtaacgccaagcaatgtttgatgtgctaacccatcattcagattctccgctaattttgcaatagcttgtggctgatcaccggcgggttgaaagtcggaatgtaaaataaaaggcttactgttaattttgctcatagcaacaaaaatactaaaaaagggcggtgcattctagcataaaaaaacgtttctttactgacaaaaataggataagataacccgaatttttacttgacaaataaaatagaacagaaaaaatgacagtctacagtctacagtctacagtctacagtctacagtctacagtctacagtctacagtctacagtctagtatgttgcctaaaatcaacctttcaagttaaatttgagaggttggacatgttcaaacaatatcttaaaaatcacctatttcaacctcaacctttcggcgaagataccattcgcctttttttgttgtgtcttaaaaagcaaggcatttcctgtttaggtttataaccaactcctaaaaagtttactaaacaatcaatcaaaatcaacgcaagaaataattaatttaaaaaatccatttttaaagagaatagagatatgaacaaaatattcaaaaccaaatacgatattaccacaggtcaatgtaaagccgtttctgagttagccagcaatcgccaaatagcgagcagttcggagagtaagccgaagtgcggtgggttttggggtaattttttaagagcgtttaaggtccttccgttggcgttgttgcttgcgggatttttctctaattttgcttatgctgctaatgtttggttagaaaataaaaaagacttatcacaaaatggacagttaaatgaggggactggtgtttggtttgacggttcaaatatggaaaacccgagcaaaactgagtcaaccatcttatcgagtggagaaaattcaacaggagaatttgctcaaaaagctggttttaaaaataaaagttttaataggacagtcgtaataggctcacgtgccgttggaggcggagatgctactacggtaataggttatagagcaattgcaggagcaaatttatctgaaagacataaattatcttcgcaaggtacatcgataggttacagaacatttgctagaggggaaggggctactgcaatgggaaatgattccactgcatggggagataacgctattgccattggttctgataatgcgaaagcaacaagcacttcacaaatagacagcagagcagaacgtcctttaagtagagatgtttggaatcttgtacacagcaaaagaagtgattttctttatacagatgaatacgcaacaacatatcaaaagttggatacttatgacaagtatttaggagtaaaagatgattctgaagcatataagctaaaaagatcccacacatgggcaaggggacataactctatcgccattggggcaagaagtatagcctacggcgataacagtacggctatggggacgttagcgacagccatcggtaactactcgacctcgttgggggcattttctatggcgtttggagatcgttcgattgccatagggaatgaaagctatgtgtatgccggcggaagtgtcggggttggtaatgaggtgcaggcaatcagtgatggtgcgatggtttatggcttggaatcttatgcgggcggtgatggttccattgccatagggaaacgtgctttagcaaacgtagaaatgggggatatgtttaagaatgctgttgaaaatggcaagaatttatacgaagcagagagtactttttcaaagttaggcgaattagataatagcgttcaagattactttaaaccaagcactgagtatcagcagggttccggggaacacaaagccaaacgaaataaaaactcaggcaagcaagatgctacaggcggtttagccattggttactatgtatccgcactaggggaaaattcattggcgttaggtcgtcaagcctatgcgaaaggcgatcgctccatggctatcggtccttatgcctatggtgctgaggaaaaaactgctgcactgggttatagatccaaggctataggaaaacaatcaatggcgttaggatcgctatctcgtgcagaggggaaaaacagtatcgctattggggtcaatagtgcggtgaaaaatgaatctagtagtaataaaagaaacggtgtaaacacgatagccatcggtaacgaaaccgaagcgacgatggataactcagttgccttgggttataaatccaccacaaaatatttttataataagagtgataacagtaccgccacgttaaacggagatgaagccattagtttgccatcctatgcaccggaagggacaagctataagttacaaaccgataatgcggcgggtatcgtgtccgtcggttggaaaaaaagcgatagtgaacttggtctaagaagaattgtcggggtcgccgcaggagcattggactccgacgtcgcaaccgtgggtcagttaaaagccttgtattacgtcaaaaaagaaggggtagtcacttactataccaaagaacctgacgggaaaatcaccaaactcaccaaagacggcagtaagttttatagagtcaacaccaaagacggcacgccttataaagagttgcaggaagttgatgcaaaagatgttttcgtcggtccaaaaggggcgaatgaagaaacaagagaagaaatgaaagacggcaaaaaatattcccttggtaatatgggtaatctaattaaatttgccaatattttagatggagagatttctgcgacttccgatcaggcggtaacgggtggtcagcttaacgatcttaacggcaaattaggattgacactaaatagcaaaaaaacaggctttgagaaagtccaatttgatgcagtagaagtagctgatgaaaacgttaaaaaaggaaaaatagaaaatttcaaagaagccttgactgactctatcgctgcaattaatagaggttataaatttattgatgacaactctcaaaattcagacaaagatacacctttctatctcggatcaacaataaaaattgtggcaggaaatatttctgcacaaccgaatagcaaacctcaagaaacatatttaggtaaaaacctcaaaacaaaatttgaaaaagagccaagcaacaattcaatcgctaaatttacgattggcttaaaagacgatccgacatttacaaaggtatccttagaggcagaacaaacatataattctgacccatcaaaaaatacagtcaaagatacaaaagaacttatcactaaaggttacttggacggtgcattaaaaaacgtcgcctcaagtttcacggttaagggagatgatacaagtaaatcattgagcattgataaaaatcatacgactttaactattaaaggcggaaacaatattaccacagcagttgatactaaccaaaaagccttaaccatatcgttgaatgagagtttaacaggtattacctcaattagcggtaaaaatggtagcggaagtaacagaagtgcggtagcaaaaattgagtttgatagcactgcaagcggtagcaacgcttcaaccccgaatgtcaaaatcaccacaggtggtggcacatttatctttagtgaaaacggcttaaatttgggtagcaaaaaaatcactggtttagcagagggttcagacgacaccgatgccgttacctttaaacaactaaaagattcaaaattgcactttttatcggttaaagccccgacaagcccagagtcaaaaagcaattacaataatgacggtgcaaaagctgaaggggcgattgcgattggtgtggatgcgaaaactgataaagcaaatgcaattgttatagggaatagtgttactgttgatcaagaaaaatcaatagcgttagggaatgatattaatattaaacaaagtaaagcaggatattcaactgttgcaataggtaacaaaataacaatgaatgaatctggtggttctattgttttatctgctatgaatcaatggaatggtcctgatgatggtataacactaaacaatgttggttggggtgttatattaggaaataaaaccaaaatagagggcggaaacgatattgttgctttaggtaacaatatgaatgtgactaggagtaatggaagcaaacacgatctaaatagcaatttgatcatcttaggtaatggtgcaaaagcccatgatgcaaaagaaagtgtggtgattggtaatgtcgcagacgtgaaagcccaaagtgcggtagcgattggtaaaggagcgactattgaagccaatgccacaggtgcggtagcgattggggaaagtgcgactgtatccactaacgctggtgattccattgcgttggggaaaaattctaaggcggaaatgaaaaaggccgcaccgactggatttacggttaatgcaggggcaaatgacctaaaaattacttggtccagtgcaggggctggtggaagcaaatctgtggtgagtgtcggcgataaaggtagtgaacgcataatcaccaacgttgctgcaggtaaagtcgatacagattcaaccgaagcggtgaatggcggacaattaaaaagcgttatcgatgtctttgctaatttgggggtaactgtactcggggcggagaaaaacgatactggcgatggctttaagaaatccaagtttgatgcggtgaagactggcgacacagtaaattctcaagctcaagtaaaatctgagaaaccctttaaaacagccattgaagataatattacagccatcaacaaaggcttgaaatttgctggcgataacggcggcgaagcgaagcaactctatctcggttcaaccttaacgattaagggagcgacaggtcctgcttcaaaaccaacaacaagtgcggggcaaaacggtgcaggtactcatcaaaatatctttaccacagcgaaaaatacaggcattttggaaattgctttgaatgaagagttgaaaggtattaaatccgttgctaatggagacgatgtaaaaattgaattaaaaactactggaactggtggaaatggaactacaaaatctatcgttttcacagctggcgatacaaacaataaagtaacgctaactggcaataaattcagtggcgtgtctgaaattagcagtaaagacagtaaatctaaattaacacttggtgctgataacgcaactgtagaattagaacatggcaaatcaaaacttgaactaaaagatactgaagcaacaatcacagcaggaactgatgctggaagtattaaaattaacaataacggtgatacgaaaattgagttaagtcctgaaagtggctctacagttaccttggcaaaagacagcacgaatggcgtaaaagccacaggtttatctacagttgggttagatggtgataatactttagtgtttaaaaatggtacaaatagcactaacacggcggagttaaaagtcggtggtgcagctttaacattcacctctactggaaatggaactggcggaactgctcaaaccgtgaaaatctctaatgtggcagctggaaaaattgatactagttcaaccgaagccattacaggtaaacaacttgctgatttagctactcatttaggggttagtgttgatagtggaaaaactgggtttacagcaccatcatttgaagttatcaaaggcggtactaaagacgcaacgagcggtaagaatggtcctacaacctttaaaggagcgattgaccagttaatcaccgcagttaatggtggtttgacattcaaggggaatgataacagttcgactaaattacaattgggcggtactttaaccattgatagctcaacggttggtagtggtagtgaaaaagacattacagcaaaactggaaccgtctaatggtaatgattctaaagatgcagggaaattaacattaacgttaaataaagctacttctgtagataaaaatgacgaaaaagtcattacctcaaaagccgtagcaacggagttggaaaaatatacgaaaactgctgatttaggtaatgcgtatttgaaaatagatggatcgaatattggcgatgcttccaataaaaaaacattcggtggtcatgtcggtattgctgaaatcaagttagatggtgaaaaaagcagcactgaattagtacaggcggatgcggttattaagtacctaaaaggtacaggaccagattctgtaaaaatatcagactcaacaaagacaatggctaaaggaaattactcaataagtataggacatgaagccgtatcagaaaatgcagaatcaatagcgataggatatatgactcatgcacaaaataaaaaatcgatagcattaggtaatgaaagtgaggtattgggcgagaaatctattgcaataggtacagagaataaaatagatggtgagggtaaatactcaaccgtattaggcgtagagaataaggtatcaagtaaatttacttatttaataggatacaataatgatatcaaaggagataatacctttgtattaggatctaatatattaacagacaattctattaaaaatgcagtaatacttggagatagatcaaaaggagaagcaaatgcggtatcagtaggtggtgctggcgatggtgaacaacgaagaattgtttatgttgctacaccaacggataaatacgatgcggtgaataaacaatatgttgatggacttggattaaaattcaaaggtaatgataataaagagatacataaaaaattatcagacacattagaaatagttggtaagggtttaaataaagctcaaactactaaatttaatggaacaaatggaaatattgctgtaaaagaaaataaagggaaattggaaatatcattaaatagagatttaaaaggaattaaatctattagtgatagaaagaataaaaatatagctactgaaataagattcaatagcaaaaatagcacaagcagtattcctaacagtttgacaaataacctaactatttcttcaaatggaggcacatttgaatttaatagaacaggtttgcatattaacaataaacaaattacagggttaagaagtggactattagaaaaacataatggacaagatagagaaagaaaagatttaaactatttaataggagatgaatttaaaaattcctctattcaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcgactggacaaccagcagtaactgttggcacaggaacaacttctcaaacatcagctgttaagtacacaggagataatttaacaactcgatatacctatgacagtagcaatggcaacgctaaaatcgaaatcgggtttaaagacgcaccgacatttagcaaagttaccttatctcaagctcaaacatatggtaagggtagcagtgttggaaataacgacttgattagcaaatcctaccttgacgctgcattaaaagactttaagtttaatgtggaatatggtggtaagcaagtccaaatcggtcgtggcgatacgttgaagtttgcagacgggctgaatattaaactggagttaaaagaagtcgaaaaaccggcaaatgaggcaacgtctaccattaattcaaatatggaaacttctaccccagcaccaacaacagtaagtaccccatcagatggtgcaaatgatgcagacgtggctacaacaacggcagaggtaaccattgacacgactgaggaattgaaaaacatcacttcgatttcctctaaaggaagtgcgggcggaaatgatgctgactcaactgtagaagtcaccaaacttaccttagaagctgataaaggggcgactttccgagtgggcaacacgggtgctaaagtgaatgtcaatagcgatggtatttccctcacaccgaaaggggcaagtggtacgagtccatctgacgatgtagcatctatcactattaaagcaggctcaaaaccagtggattcaaacagtatagatttacttgatccagctaacggaccttcaatagcgtttgcagccaaaggcggtagtaatggctcaaaagagggaactggtacaattaaatacctcaaagacagaactgttagcaaaaacaatggcaacggcgataaatacggtgagggcgataacaaaggcaacgcagctacagaaggggcggtgaaagagctttatgaatccggtttgaaattcgccggcaatgaaggtgagcctgttcacaaaaaactgggtgaaaccttgtctattaaaggcgaaggtgcggttggtgaaacggcgacggataacattgtggtaagagccaaagagggtgaactgcaaatcggtctgaccaaaaatattagaaatattgacaccatttctatcgctggcacaggggacaatagcggtaaagatgtctttatagatgctgagggtatgaccactactgctcaacttgaagatggcacggtgttggtgaataaccaaacggctgaaggtgtcagtacaatagctaaaaaagaggatggtagcattttggtgaataatcaaacagcagaagcgaatattttaagcaatggcaagcacacgacagaggtgaaagccggtgaggtcgctattaaagacaagagcggtcaagaaatcgtgagcttgaaagtggctgagggtgaaaacggtcaagatggcaagggagcgacgcttgcgtttgccaaagatggcgaaaacggtacaggcgtaatcatgggcttgaaagacctagatgccactgctgacggttcaagtgcagcgaataaaaactatgtggatgaaaaaatgtccgatttggacagcaaccgtccgtttaacttctatatccaagagggcaaagagtataccaaagtcgtcaaaggacgtgatggtaagttttatgatcctgagcttttacaaggggcaaagtatgatgtggacagcaagaaatacattgctcaagatggacaagaagttacaccggaatcggataaagtcattattcgtgctgaaccgactaccgcacctatcgggattaataatgtggcaagcgggttgggtattttggctatagaagaaagcgagaaacaacaacttacgcaagctgttgaagataagaaaaacaaggtaagcgaaagtgaaaaggctcttgctcaaactactgctgatgttaaaagtaaacaacaagcacttactgaaaaaacaaatgagctttcacaagttgccagcgaacgtcccgtattgttgatgcaaaaagctgaccttgagcagcaacttaaaggattgggtgcgagcgatccacgaagagcaaccgcacaagccgcacttgataaggtaaaagaggctcttacacaaaatgatcaaaaggtgactgaggcgacaaaaacagctaatgaggcttccgaagctctcaaacaagcgaaagtcgctttggcagacaacgtgttaaaagcctatgcagcacaacaagcattagctactgccgaggaaaccttgcgaaataaagaatttggcgtggataaggtgaaagacttactgtcaggcagttcaaatattgctgaggataatgtggctactattaaagatgtgaaagcacttgctaaagcaggattaagttttgagggcaatgatggtaaacgcttgcataaagatctatcagaaactttagcaatcaaaggtgaagaaaatgcaagtggtgataaatttaatagcaaccacaccgccgccggcaatatcaaagtggaaatggcacaagacggtaaaggcttagaagtcaaattgtctgaccagttgaagaacctcacatcggttgaaactaaaaaagacgaccaaggcagatcaacaacattgctgtcccgtggagtgatggttcaaaatgacaccacaaaagaacaagcccagttcagcgaaaaccgtttagcgttctttaaagatggagcgttaggattgaatttagacggtaagtctcgtgcattgaaagtcggtgaaaaagcgatcatcagtataaacgacaaaggtgaagcattggtttccgatctgaatgaatttagttcaggtatgacaattaccaataaaaactatgtggataccaaaaacaatgagttgcgtacgcaattgaataatactgaccgcactttacgagcaggtattgccggttcgaatgcggcggcagggttggcatcggtctctatgccgggtaaatctatgttagccatttctgcagcaggttatggcggggaaaacgcagtggcaattggctattctcgcatgagtgataatggtaagattatgctacaactgcaaggaaatcggaattctagaggcaaagcggcgggttctgtttctatagggtatcaatggtaaattgattcgattgtgccttatgtccacattttgttgttgaggatataaggcataaaaagcgtgctctgttttaaaatcaacttggtaattgttgttcgatttattgatgagtcattaagtttggtttctttttacatagacaaggtttaaaatggattagattctgttttaaaccttttttacaattggacaaatcttttaatatcaagaataactgtctgtatctatttcaaatagctatattgctatctatgatgatggaatattgctcttgatgtttgtagcaaaaaattacatagactttaaacgaggagaagaaatatggaaaaattcgatgttgtgattattggtgcaggaccttccggttctgtttctgcatcattattgcataaacaaggcttaaaggtttgtgtgttggaaaaacagcatttccctcgttttgtcattggtgaaagtttgttaccttattgtatggatattttgcaagaggctgatttggttgaggcggtgcatgctgagaaaagttttcaatttaaaaatggggcggcatttacttggggaaatcgttacacctattttgattttacagataaatttaccgctggacctggcacaacctatcaagttcgccgaggcatttttgataaaattttaattgatgaaacggcaaaaaaaggtgtggaagttcgttttgggcacgaagtatcggcgtttgataaccaaggcgatcaggcagagcttgcggtaaaaacggagcaaggggaagaatatcggctgagtgcaggttttgtgttggatgccagcggttacggacgtgttttgccacgcttattatatttagaaacaccatcgcacttgccaatacgtattgcacattttacccatattgatgacaacattgatgatccgatctttgatcgtaataaaattctcattaccacacatcctgaacatcgtgatgtttggctttggttaattccctttgcggataaccgttgttcaatcggtgtagttgggttaccggaaatattggcgggtgagagcgaaactgtgttgaaaaaatttgctcttgaatgtccaatgctgagtaaaattcttgctaaggcaaattgggaaaatgaatttccgtatcgccatattcaaggttattccgctaatgtgaaaacgttgcatggcaaacattttgctttattgggtaatgcagcggaatttcttgatccggttttttcatctggcgtgactattgcgttacattccgctcgcttggcaagtcgtcttattgctcgtgggcttcaaggacaagctgtggattggcaacaagaatttgcagatccgttaatggttggcgtgaatgcgttccgcacttatgtgaacggttggtatgattatagtttccaagatgtcatttatgcccgtaatccacaacctgaaattcgccaaatgctttcgtctattcttgccggttatgcgtgggatgagaaaaatccgtttgtgacgaaatcctcccctcgcttgaaagcacttgcggaattatgcggcgaggcaacacaagattaaaataacaatatataagcattcaaaaattgctatttgcaaacgttgagtgcttttattttttcataaggaaacaccatgccatcgtttgaaaatctttcttttattaccgcacttttatttttttgtatttgtctcattttattttttatttttgtacgtaagcaaagagaggtggaggcgttacaacaagagttagataaaaatattaatatttttaatcaattgctgaataaatatgaacgtataaaagacgaaaaaactcagcttgggcaacaagttgtaaaggcacagacacttgtcgaaaccggtcaaattcgtttgtcggaacgtgatgaaaaaatcctttatttgcaaaaagaattagataaagaacaattacggtgtgagcaagtttctcagctggtaacaggattgaaagagcgtttgggggtagtaagtacacaggcggaaagttttcaacagcagttaaatcaaagtcgtgcagaaaaagaaaagagagattgtgcttgggctgatttaaatcagaaacataccgcacttcaacaagaactgacagaattaaaagtcacgttaagtgaaaaagaaaaaaattttgtcgagcaacaacaaaatttttctcaggctaaacaactgttaagtgttgagtttcaaaatcttgccaatcggatcttggaagaaaaaagtcaacgatttaatcaaactaaccaacaaactttagacagtttattgaaaccttttcgtgaacaaattgatggttttcaaaagcgggtgaacgaaattcattccgagtccttgaaaggcaatgccagccttgaaagtgaaattaaaaaggtgttggatattgggttggcaatgtcgaaagaggcgaataacttaacttctgctttgaaaggcgaaaagaaaaccttggggaattggggagaagttcagttagagcgtacattgcaattagccggattgattgaaaatgagcattacagcagtcaagtacattttaaaaatgagcagggcaaacataattatcctgattttattttgcatttacccgataataagcatttgattattgacagtaaaatatctttggtagcttatgaaagtgcggttaattctgacgatgaaaatcaacgtaaacttggtttacaggaacatgttaaagccttgaaaaatcatattgacgatttatctcggaaagattatagcaatttgattggtatgcgtagtccaaattttgtattgatgtttgttgctgttgaagcagcttatattgaagcgatgaaacatgacagtaacttatttaattacggatatgaaaaaaatgtcattttagtttctcacacgacattaatgcctattttgcggacggtagcgaatttatggcgaattgagcgtggtaatcttgaggcaaaagaaattagtgcaaaagcaggtgaaatttataatcaaatttgcgtagtggcagagcgtttaaataaattaggtaacagtttatccggtgtaagtaatcattataataataccgttaccgcacttgtaggacagcaaggtttggtggggaaagttgagcggttcaaggatttatccgctaaggcgaacaagataatgccggagattgaattgttgcataatgatataaacgttgagaaattaattgccgttcaagctgaagtcgaagagaaataggatttttaggtaaaaatcttttaaaataatgacagttttgacataagagggaatacattatgattattgttacaggtggagccggattaattggaagtaatatcattgcggcattaaacgatatgggacgtcgagatattttggtagtggacaacctgactgatgggacaaaatttgtcaatttggtcgatttggatattgcggattattgtgataaagaagattttattgcttccattattgccggtgatgattttggagatattgatgcaattttccatcaaggcgcttgttctgctacaacagaatggaacggtaaatatttaatgcaaaataattatgaatattcaaaagaactattgcattattgtctattgcgtgaaattcctttcttttatgcctcaagtgcggcgacttatggcgataaaacagactttattgaagaacgccaatttgaaggtccgttaaatgtttatggctattcaaaattcctatttgatgaatacgtgcgtcaaattctgccacaggctacgtcgcctgtttgtgggttcaaatatttcaatgtatatggtcctcgtgaacaacataagggttcaatggcaagtgttgcattccatttaaataatcagatgttgaaaggagaaaatccaaaattatttgcaggatcagagcattttttgcgtgattttgtttatgtgggcgatgtggcaaaagtgaatttgtgggcatggcaacatggtatttcaggcatttataattgtggaacaggtagagcggaaagttttgaacaagtagcaagagcggtgttgaattatcatggcaaaggtgaaattgaaactattccgttccctgagcatttaaaatcacgttatcaagaatatacacaagctaatttaacaaaattacgtgccgctggttatcaagcagaatttaagtcggttgctgagggagtagcggaatatatgcaatggttaaatcgcaagtcttgatttagcgaggaaaatagtgttaaaagtgcggtttaattgggtgttcatttattcggtattccttttaaatctgcaactaaaaagactattttgctttataatatcggcaatcttcactgttattggtcaaaacctatgaaaattctcgtaattggaccttcttgggtgggtgatatgattatgtcccatagtctgtatcaaaccttaaaacaacaatatcccgattgcctgattgatgtattggcaccgaattggtgtaagcctttacttgcacgtatgcctgaggttcgcaatgcgattactatgcccattgggcatggttcctttgacttaaaaggtcggtatcgaattggtaaatctttgcgtaatcaatatgatatggcgattgtcttgccaaattccttgaaatcggcttttattcctgcctttgcgaaaattcctgtacgccgtggttggataggagaaagtcgttattttttgttaaatgattggcgtcgcaataaaaacgactatccgatgatggtacagcgttatgtggcattgggttatgataaaaccgtattgccgacagcaaaacatttagccattcctaagccttatttgcaagttgatgctcaagagttggaacaaactttagaaacttttgcaaaacaaaccgcactttgtacaaatcgtccggtaattgggttttgtcctggtgcagaatttggacctgcaaagcgttggccacattatcattacgccgatttagcccgacagttaattgaacagggctatgccgttcgtttattcggttcggcgaaagataaagaggtaggtgagcaaattagtcaagcgttgcctcaaaaattacaacattattgtgtaaatcttgctggtgaaacagacttaaatcaagctgttgatttgatttcagattgtgtggcagtagtgagtaatgatagcggtttaatgcatattgccgccgcacttaacaaacctttggttgctgtttatggaccaacaagtccggaatacacgccgccactttccgacaatgctgtgattattcgtctaattgagggaggcttgattaaagtgcgtaaaagtcaagatagctcggaaggttatcaccaaagtttaatcgacattacaccgcaaatggtcatcgaaaaattacaggattttttaaattaatatgaaagtttgtttgattaaaaccagctcaatgggcgatgtaattcatactttgccagccttgactgatgctcaaaatgctattgctgatctgcaagtggattgggtggtggaagaaaattttgcggaaattccccgttggcattcagccgttaatcatgttattcctctagcaatacgacgttggcgtaaacagcttttttccgctcaaacaagaaacgaatggaaaaattaccgcactttgttacaacaaaatcaatatgatgcggtaattgatgctcaagggttagtgaaaagtgcgttgtttggagcgagtttagcgaaaggggtaaaacatggttatgatcgtcattctattcgtgagcctttcgcctcatttttctatgacaaaaaatatactatttcttatcaacagcatgctgttgaacgtattcgtcaattatttgcccaaagtttaggttatgaattgcctcacgaaaaaggcgattatggtattgcgaagcattttgtgcattcgactgaaaatgcacaacattatgtcgtttttgttcatagcactacaagagcggataagcattggctcgatgcggaatggaaaaaattagcccaaaaattgaccgcactaggtttgcaaattcgcttaccttggggtaatgaaaaggaaaaagcacgtgccgattggattgcacaagatattcaaagtgcggtagttttaccaaaactttcattgaccgagttggcacaacagattacctatgcaaaagcggtagtttctgtggatactggattagcacacttgactgccgctttagatgttccgaatattactttatatggagcaacagatccgaagttgatcgggacgtatggtaaacatcaacattatattcagaaacagggtatggcgttgattagtgcggaagatgtgttgagtgaattacagtcaaaagaaatattgaaattttaaccatagaacatctgcactttgcatttacactaagtgcagatgaatttgattataaacggataacgccgtcataaatatgtgttgcctcgccggtcatataaagtgggtgtccttttccttgccattcaatcattaaccttcctcccggcaaatcgacttgtacgcaactacctaaaacgccctgcataatgccaacggcaactgctgcacacgcaccgctgccacaggcttgtgtttctcctgctcctctttcatacacacgcagtttaatatgattgcggttgataatttgcataaaaccggcatttacacgttcaggaaagcgttcatggctttctaagagcggtcctaatatttcgatgtttgcgtgttgaatatcttccacttgtgttacacaatgtggattgcccatagataccacaccacatagcaaggtttgtatgtctgtgcgaataatataatttttttcaaatttattggcgttaaaagggattttattcggttcccaaatcggttcacccatattgacacataccatgtcatcgtctttaacgcataacatcattttgccttttgcagtactcacggcaatttcttttttattggttaaacctttaagcacgacaaaacgagcaaagcatcttgcaccattgccacattgcgaaacttcactaccgtccgcattgaaaatacgatagtgaaaatccaaatccggatcataaggcggttcaacgactagcaattgatcaaaaccaatcccacgattgcgatctgccaatctttttatgacttcagtgggaaaataaatgttttgagtgacagcatctaccacaacaaaatcattccccagtccgtgcattttggaaaattgcatttcctcttccttaagcaaattaaaattggagctattataatcagctgcttaaattgagtaaatgagagaaatcattcactcagattgtgaaattcatatttttttctgcaaaattgtatcgtataattctccgccagtttaaaaagataaaattaaactatttaaaaaatttatttctttgatacataaggagtttttatgaaatacaaattatctttagtacttttggcaatgctgcccgcactttcccatgcgggggggggaattttaacttttacggcaaagcgggaattgatttaacctctcgttttgaaactatgagaataattgcaaaccatgatggtaaccctcccatttcagcaagttcaagacaaaatactttctcgccaagcatcttttttgaaaccacttataatattttaccgcaaacagaaatcggtctaggattaggctatattaaacgcaaaggctttgagcattctgcaagctggggaattcatggaggaggagagtatgcaccgatttcagataatactggaatcgaaacctataaaatacctcgttatgcctccctgccaatttattttattctaaaacaagattatgccctaagtcgaaatacaaacctgtatttcaaagcaaatttaggttattcaatcaataaaatttccaatacacaatataagtattatacagatctagagcaagaaaacgtttttaaattatcggagtttcagagcgggttgcgtccgatgaaagtgaaaaatggtctttatttaggtttaggattggggattgaatataaagctttcttagcagaaattggctattatcataccaaatcaaaagtaactcgtaaaaactataactatgagattagaaactcgatctacgaaagtacctcttacaataatgatgccatacgtttaacccttggggttaaattctaaaagtaacattctctccgcactttgaggcggagagaatgttaagtttttgttttataccacgccaagataaatgtagcaatttgcgtcgggttgttaatatccagtaaaggaacggaagtctgtacaggataatctgtcgctaacgctattacatattcatcacaaggcggacaaggttttgtcatattttgacgatgtaataaaattttggcgatggggtcttgtttaaacccttctactaaaattaaatctgtcaattggggtgaaaattgttgagcgagataatctaaagtgacaggttttggcgtttcggtcattaatgcccaacggttatcacatgccaacataacttgtgtcgcaccaacctctttcatacgccagctgtcctttccctctttgtcgatttgtgcgttatgatggctatgtttgatgactgaaacccgcaaacctaaacggagcaattcaggcagtaatttttccaataatgtggtttttccgctaccgctataacctgtgatacctagcatgggttgcatataaattcctcttttattgaataatgcgtaacagaatgggttgaaaagcctttttatgttgccattttttactgtatgaatggataagcacaaaagaaagtgcggtacaaaaaaggataaaaattgcaccccacaattcttggctaaaaatttggtttgcaatgagtgttgcactgagcaaggtcattaaaggaataatatacaataaaagtgcggtagaaatcagagaactttcttgtaaaccaagctcaacaatttgacctatttttaagggtatcaggctattaacgataaagatatgctccggacttttgccggttaattcagaaagtgcggaagttccgcaagtattttttgctgtacattggctacaagcatttttgctttgacatttcactgttgcttttccttgatgataggcaatgactatcgctctttctgttagcataaaaaacctatttaattcgaatatcttgaataatacgtttagcggaaaagagaggaagttgaccgacaaaggttaattctttgttacctagagtgttgctgtaaaaagtggtggagccttgcttccaaaatctttctccgtcattatcaacaatgctgttagacaaatagagtgcaaaagaaaatagtccgtcactataaaattggctctcaatagggtgtttattgtctttttctattgttatggattggctaattaacttaaacccttttgggagccactccggtttccaattttgttgttgagttttcggttcacttaataacggaggaaaaatgacattatctatatagctacctaattcgatcagttcatcaccaagatataaattaactactcggaactgctctaataaattgccttcacgatccaacatatcactgcgtagcaacaaatgattttgttcatcgataaagactaaatattgatagcgaaaatcgtctttaggcaaaatacgtaaagtttgtacaatgcgatccgccacacgattacgcccaatggttacgatatcgtaataatctgataattgcttaacatcactccacattacaacaggtaagttatccataatatgaccgctctttaaagagaatgcttggaaattaggttgaaaataactcactaaattttcatgttggataatttcttgttgaacaccatctaaggtaataagttgggcgtaacttttgccatcctgattaatatgacgataacgaagtgaatctatattggttggtgtggcttgtacaaaataaatttcataatttaatgtattttgtgctgcaatcattttttccaataattgctcaggttctatattttcttgagcgaaagttgaaactgaaaaagtaagaagtgcggtcaaaaaagagaaaatttttaacatagtattcttcctaagaaaaaaattcaccaccaaacggtggcgaatatcttaacatgaattgagctaatgttcattatttggcaatccgaaactgtcagtatgcagacgtcgctgtaattcatagttttgtaacattatgccaatacgtttgttccgttgttctacttgctcctgcgtaattatttcttttctcggaacattatagctgatttcttgtaccgaattattaaatggaagcgtttgtagcgttggggtatccagtgtatttttgcccgctctttcatgattaaaagattgaacgccaagtacggcaacgaaacaaaccgttgcagcaactgccatttgtaacattggggaaaagaatgagcgtattttttgtataaacggaagtttttccacttctgcgagtgtcggttgagactcgagagaatgttcgatttgtattttttcttcctgttcaatgagcgttcccattcttgctgtgaaatcagaacctaacagcactttactttctttgcgtataatggaacgaattaaatgataatttgaccaactattttgtaagtctttgttttgacaaagggtgtcagtaaatttgttaccacaatgctcaccatcgatataagctgaaagtaactctttttgcatctttaactccaagtctttgcttattaaactatttaacgttgtatcaaaggttgaattttgctttcgattatttctcttgcacggaaaatacgagaacgtacggttcccaccggacaatccataatttctgcaatttcttcgtaactcaatccttccatttcacgtagtgtaatagctgtttttaaatcttcttgcaggttactgatagtatcaaaaacaacttttttcaattcaccggataatatttcattttcgggagtattcacgtcccttaaatttgtaccaacattataactttcagcgtcttctgctaatatatcctctgttggcggacgccgtccttgtgccgttaagtaattctttgccgtattaaccgctattcgatatagccaagtataaaaagcactttcgccacgaaatgattcaattgagcggtaggcttttataaaggattcttgtacaacatcgggaatatcgttttgtgaaatataacgagtaagtaatccagcaactttattttgataacgagcaaccaataagttaaaggcctttttatctccctgctgtactttttctaccaaagcctgatccgttagttgttcagccatataacctcttgtatcacatctaacaagccttaatattaaagccagccaacccctgtgcttgttagacgtaatggaataaaaaaagttcaatctttttaggaaagattattgatataaatttaaattttcttgaatatgatctaccatctcttgtaattcaagatcagcagccggagttttattaaaaaaccaagaaaaaagttgtaaatccgagcaagctaataaacgcaaaaatatatcttttttagcatcaggtagttcatcaaaatattgttgaaaaaaaggcataataactttatctaattccaacatgcctcggcggcaatcccattcaatgcggaatttgttgtatttttccatgcttaatttccttttatctaattttcttgttaatagtaacaatcggaagaaacgctgtaaataaaagagatgaataaactcggttcggatagattttaggtgtgcaatataaatggcatacaaataaggcgtattatatatcaatacgcctttgcttttaggtgtaaatccctttaacttttaaccagctctactacttcacgggttaatcgtccaatttcttcccattgttgggacttaatcaaagatttctctacaaaccaagagccaccgcaagcaactacgtttggaatagcgagatagtctttgatattttgtggcgaaatgccaccggtcggcataatttgtaagttaccgtaagggccaagtaaggcttttatcattttaacaccgccacttgcctcagcagggaaaaacttgacagcttgtatgccgagttcaagagcggattcgattgccattggattatttacccctggcgttacaggtatatttaactcttgacaatacttcacaatatttggattaaagcctggagtaacaatacaatttgctccggcatttttggcagccaatacctgttctttggttagcaccgtgcctgcagctatgagtacttcaggatattgttggtgaaccaatttaatggcctcttcggcagcttcggagcggaaagtaatttccactacaggcaagccgttttcagacaatgtttttgctaagggtaaaatatcctctgctttatctaaagcaataaccggaacaactttaagctgtttcaacttgtcaataatttgttcagtggtataacgcatttttaacctcttttttaatgtgaaaaaatttctttaaaatggttattttatttgaaataacgttttgcattgtcatagcaaatgtctttcaccatctttcctagcaggttgagatcatttggtgcttcaccacgttcaacccagccaccaatcatttcacataaaatacggcggaaatattcgtggcgagtgtaagataagaaactgcgagaatcagtcagcataccaacaaattggcttaatagtcccaattgtgatagctgttgcagttggcgttccatgccatctttttgatcgttgaaccaccagcctgaaccgaattgaattttacctgcaatgccccctgtttggaaattaccgatcattgtgccaagcatttcgttatcacgaggatttaagcagtataaaatggttttcgggagttggtctgtttgatccatgctgtctaataaacgagaaagtgattcagcaaacgcacgatctccgattgaatcaaatccagcatctgcacctagcaatttgaacattctcgtattgttgttacgaattgctccgatatggagctgcattacccaatggtgtttgtggtactccgtgcctaaccaaactaatagtgcggtgctaaattgtgcaatttcttcttcttcaataggttgattgttaagtcttttttgcaatatttgatcaagagttttctcatcaggaattggtgagaaacggacaatttccataccatgatcagcagatttacaaccatatttatcgaaatgttcaatacgtttcgatagagcctgttttagtttatcgaaagtgttgatttcaatatctgcgacttttcctaactgctcaatataatcattgaacagaggaagctcaattttaaacgcacggtcaggtcggaaacttggtacaacctcaacatcaaaggtattatcttctgcaatggctttatggtattccaatgaatcaataggatcatcggttgtaccaaccaaatttacattcatttttttcataataccacgtgctgaaaactcaggctgttgcaataactctttccctttatgccaaattttctccgctgtttcaggtgaaaaaatcgtgtcggtaataccgaacggacgacgtaattctaagtgagtccagtgataaatcgggttaccgatacattttggtacagtgttggcaaatgcgagatatttactgtacttatctgcacttcccgtaattaaatgctcttctaccccagctgaacgcattgctcgccatttgtagtgatcgccctctaaccaaatttcagctaaatcattaaattggcgattttctgcaatctcttttgggtttaaatggcagtgatagtcgaaaatcggttgttcttcagcataatcatgataaagcttttgagccgttgaggttgatagtaaaaaatcttccgtcataaatttcatcattatgtcctcttattgagttattttttgttctaatatacttgcattttcgtccactttttctttagaaagcgggtaaacgtatttcaacagtaaaaaaatcaagatgcaagccaatgcaggtactcccgttgcaaagttatagattgactctaacacttcttgtggttgttgtgggatttttgcagaatagccaatgtaacttagtgcaaagccacctaaaccaccagctaaagcttgaccgattttgcgagcaaatgaataaactgcataaattgtgccatcttcacggcgtccagttttgataaattggttatcaataatatctgtaataaatgcccatataataatttggaaataacttagacccagtgttgcaatgagtgcaacaatgataaataaccaaacatttgtgattttaacgaagaatagcacactgtatatgacagcagttatcaataaacctacagaagctgattcttttttaccgtactttttcacaatattttgggcaaacggagcaaccataaatgttgtcacggcacctaaaataccaccaaatgacaatgctaatttactattaaagtaatcaacatacaaatatgggttcattgtaccgatgattaaggttgctagcagtaaaatgatagcgattaaaataaagataagtaacgcactgtttgagaatagactgctaaagattgcttttacgtcatctaaacagtctgatttattgtgtgatttgttgtggcgacgaccttctttttcaggcaattgaactcgctcaaccgaaaatctccaacagatttggtacaaaataaacgcacagatcataaatgctcccataatgtatgtgaacatttctgggataatcacttgtttaccctcaacttctttgtaaataatgagtggaattacaaatgagataaaaagtaccgcaatatttgcacccactgtacggaagatagataatccggcacgctcatcagcttttgtagtaatcacggaagccattgaaccataaggaatattgaccgcagtataggctaaactaccccaaactatgtaggtaacagtgatgtagaccaattttgcggtataagaccaatctttcacaatgtgcaagaaaagcagaaatcctgaaatacagataaagggagttgcccggcgaataagacctctgaaacgcccctctttaaaaggctttatagtatctactaaacgtcccataccaatatcagtaaaagcgtcaataaatctagaaactagaaatagaagaccgacaacataaccttcaatttgtagtacattagtataaaatagcattaaaaagaaggcggacatcataaaactgagatcattagcaatatcgccagccatataggcaagtttgtcttttaaaccaaaaggtctttgtgttgaactcataaaaactccttgttaggaatatagattaaatacgggtgtctttataaccacagaaagcatcaactgggctaatacctttaaactcggaattacccattaatttttctaccagtaattctatggttggttctttgccgtcataggcattgatgtaagtttttacctgaggaacatcaactaaatggaatgggcattgaacggaaacgaaaattgtaggtacttcatgtacatagaatggaatatcaggcgttcctttggtcgcttgccatacgatacgttgaactgtactcatttgcacattcgcaacattgataatcagatcataatgatccgttaatgtcgtaattgggcgtttttgggagtattcattacgaatagttttgacctgttcttcgtccgacatcttgagaatattatccatcggtgatgtataaatagaaactgtaaatcctttttcttccagtttttcttttaagatttctgttgcactgcgttgactacctgcaaccattttaccgaagccaccatctgtacctttaacatttacaagtaagattctagggaaacgttcaacattaattgggaaaatatcttgtttatgtttaactaaggtaattgctttatctgcaacatcacggaaaattgctttatgttctggaagtcctatttttgctaatgcttgttcttttggttcaagcaatgtttctcttgggcgattgtgtaagcctaattttgcttttaaccctagaatacgagtaagggcatcatgaaggcgttcttcggtaataatgccgtttttataaccttccatcatataaccgaaatcttcatcaggatcgttaaagaaaaggaataaatcacaacctgcagcgatagcagtcggtagcatttcgctacgcttcattgctgaagtcattgctaccatatggctggcatcagtaacaacaacaccgttgaaacctaatttacctcgtaataagtctgttaaaattggttttgaaagtgtcgctggtaggcagtcctcataagctaaatttggattgaaatgctgctcgtaagcaggtaagtgtatatgacctgccatcaacgatggtaaaccggcatcaattaagccttgataaactttgccgaaagttttgtcccactcttcgcaactaaaactgtttacactaaaagaaagatgctgatctctttcatccactccatcaccagggaaatgttttgcagccggggcaataccactttcttgaatacctttcatataagccaaggacatttctagtactttctctggatttgaaccaaatactcgattagaaataattgggtttcgccagttataactaatatcaacgataggagcaaaactccagttacaaccgatagctgctgcttcaataccagctacacgccccatttcataagcatatttagcatcatcggttgcaccgattttgacttgtaaaccaatttctgttccatcactgcaagcaccattaccaccagcttctgtattcgctgcaattaagagaggaattttacttttagtttgtagaatatagttttggtcataaacctcctcagcaggaccgggattataacgtaccgcaccaatatggtaacggtttaaaacatcagtgagatattcctcggatctgcttgaacccatattcacaaaaagctgaccgattttttcttccaacgtcatattggctatagtgttttttacccattgaatatcttcatcttttaagtaataaggttttttcgttaaatcaacagacataatttctccttgcttatttgtcaaaatagtaataattgtgatcaagcggttaaatttgcattaaattttgcaaccaattgggcttgatattgagaatcaaatttttggtaaaccaatttccctaatgtttctaatactaactgatcccaagattcatcttcattgccacataaaatcgggaagaaatttacacttgcttcattggcactatttaaatcacccggtgaatcaccaaccattaaaatattgttcggttgatagccatattgtgctaattggtttaaacaatgagtttttgtaccctcatcttgtccataaactagatctacaaaagggaacaaaccatgtcttgtccattcatcaagaatagcttcattatttgcggaacttaccacagcgatgtctgcaaactctttaataatcgcgagggaacgtttgactaaacggaatggtttatcttgagtatgtagagttttaatacccatattgactttttccgaccatgctaacgcaagttttagatcatcggtatggttgtcttgtattgcttgaataagtgaacgattggataattccgaagttgtatttacccagtgttttaattgggtgaaatcctgttcataaccatactcttccaaagaaagaatcaatcctttgaatcgattgataccacgtgtttgagagtaaaggttaattctattccaaatttcaataaaacgtgcttcatctgtaagtccaaaaatttcaacagcataaggtccgaaacacttatcatgtttaatgttcattgtatccattgcacaaccgtcagaatcaatgcacacaataaatttatgttttggtataaatgttgtcattattttcccctatacaccgctgtaagcagagaaaccgccatcaatcggcaatactaccccatttatgaagctggcataattttcatccattaagaataaaattccacccatcaattcatgtgcttcaccaaaacgtcccattggagtattagttaaaattttattagctcgagctgtcggatttccttcactgtcaaaaagtaatcctctgttttggttactgactaaaaaacccggagcaatggcattacaacgaatacctactttagagaaataaacagcaagccattgggtaaagttactgatagccgcttttgctcctgaataggcaggaattttagttaacggagtataggcattcatgctggagacattaataatattagccccttttttgccgatcatatctttggcaaatacttgagtaggaagtaaagtacctaaatagttgaggttaaatacaaattcaataccatttttatctaaatcgaaaaatgattttgtactatctgctaagttaaattcatgaaattcattgtcggttgttgcttttgggctattaccaccggcaccattaatcaacacatcacaagttccaaagtctttttcgatagcatcacgagtttgttgaatactttccaaatcaagtacattggttttgtatgcttttgcaatgccaccattttgtacaatagcttgtgcatattgttctgccgattcgaggttaatatctaataaagcaacttttgcccctgtttttgctatttcttgtgcaaaaaatgcacatagcactccaccagcacctgtaataacaacgactttacctttgaaatcatgattgtttgcaatattcatatttttatctcctattaagattaattgatatgctaaatatacgtctatttttaaaactggtaaaccagttattaataaaagtgtgatttacatcacaaaatttaaacttttttgggttaccttttggttttttatgtaaaatatgcttaaattatagttgttttttggtgcgcgaaatgttaatttggtgaaccagaaaagtattttacgaacaccatcaagaagtcaaaaaagcagagagacaaaaaaatgatggcaacatcacctgaagaactacgttcttataaaaaaatagggcaagaattaaaagcggaattattgagaggaacttatggtattggggataaattaccggcagagcgtgatttatctcagtacttcaatgtcagtcgtactgttattcgtgaagcacttatcatgcttgaacttgagaatttagtcgaagtgcggaaaggatctggtgtttatgtaataaatttacctaaatcgagttcagaggaaactgaagatttgcctgatgttggaccctttgaattgctacaggcaagacaattgttagaaagtagtattgcagaatttgcagctattcaagcaactcgagctgacgttttacacttaaaagagattttagatcgtgaacgtagaactttagagtgcggtgatgatgaagattatattgcagatgaggattttcacaaagcaattgcagaaataacgcaaaatgaagtggtgatccgcatgcaaaaggatttgtgggagtaccgaattaatagtcctatgtggaaaggtctgcatgcacatatctctgatcaaagttaccgctatttatggttaaaagatcacgaaaatattattgttgcaatacagcgaaaaaatcctgtattagcacgaaaaatgatgtggcagcatttggaaaatgtaaaacagaaactgtttgaattatcggatttagatgatcctaattttgatggttatctgtttaatgttagccctttggctgctgatttttaattagatgaggaatttactatggaacaaacatggcgttggtatggaccaaatgatccggtatctttggatgatgtaagacaggctggtgcaacgggagtggtgactgcattgcatcatattcccaacgggcaagtctggtcagttgaggaaatcaataagcgtaaagcattgttggaggaaaaagggttggtttggtcagttgtggaaagtgtacctattcacgaagatatcaaaacccaaacaggtaactatcagcaatggattgataactataagcaaacattgcgtaatctagcgagttgtggcattgacatagtatgttataactttatgccggtgttagattggactcgtaccgatcttgagtatgaaatgccggatggttcaaaagcgttacgttttgatcaagtggcttttgctgcctttgaactatatattttaaaacgtccgggagcagaggaaacttactcaccggaagagcaagcagaagccaaagcctattttgatcaaatgagcgaagcggatattgcgaaattaacaaaaaatattattgctgggttaccgggatctgaagagggttatactcttgaggaatttcaagcacaacttgatcgctataaaggtatttctacagagaaattccgcactcatttagcctatttcttgaatgaaattgtgcctgttgcacaagaagtgggaatccgtatggctattcacccggatgatcctccacgtccaattctcggtttgccacgtattgtgtcaactatagacgacatgcaatggtttgtggatactcaaccgcttgccgctaatgggtttactttctgtactggttcatatggtgtgttagcagagaatgatttagtgaaaatggcggaaaaatttgctgatcgtatttactttgttcatttgcgatccactcagcgggaggaaaatccacgaagttttcacgaagctgatcaccttgccggtgatgtaaatatgtttggggtaacgaaagcattactcaccgaagaatatcgtcgcaaggcaaatggtgataatcgcttaattccaatgcgaccagatcacggtcatcaaatgcttgatgatttgaagaaaaaaactaacccgggttattctgcaattggtcgtttaagaggtttggcagaatttcgaggtttagagttggcattaaaaaaagtgtattttaatgactaattaaagaataaaggtactaagtgtcttagctgggaagtatagttctggacatggtgtgaaagaaacccgacaaattgtcgggtttttttcatctaaaagaacggtctgttttatactattttttgtttgacagaagaataaattacgccggttatcaaagacacgatgctacttacaacaagataaaaagaatctgttaatcattttaggttattagtatattattttacacaaagttttaaaatttgttcgctaccctgcacgagatattgatcatcttcagatcgtactcgattatttttcaaatctaacatggcatcataaataccttgtgtcagacttgcttgatcaagatgactccaacaagttgaacttaatctattaaagttggtttgtaatccgaaagcaaagagaataccgctataataagtatgcacatcgctgtctaatccattgcgttgaaacagtttttctttaatttgattgatcgggactgaaatttttgcggagtaccaatcttttacaccactgacaaaagcgttcacatgatattctttgttcacacgaccttggtaactttgtactgccaccgcataagcagtggcataagatttttgatctattttatcattgtccaagttaatcaccgtttttatattgttttccgatgaggtataagaagtaacagattttaccgagcaagctgaaatcagcccaatacataaaaataaagatattcttttaaacataaaattatccccaaagaaaaaataaattaattgtacagacggatcggatttaagccaataaagaaaattcaccgcactttctcatttattctcaacctttaaaacaaaatctaaaaatgctatattgtacgctgttttttctgactaacctcaattatttatggctaattatcaagatataacatttgcccttgcgggtgtgtgccaagcggcaaaattagtacagcaacttgcaatgaacggtacggttgaccaagaaattttgcgaactggtttaagtacattgttgcaaactgcaccggaagatactttagccgtttatggagggcagaaaagtaatttaaaattggggttggaaaccttaatggaacaattaaacggcagtgatgtaactttaaatcgctattggttaggacttttggctttagaaggtaaattacataaaaatgcacaagctaaatctgaactggctcgtcgtattcagtatttgcctacacaacttgcccattatgatttacttgatgaacaaatgctatcaactttagcttctatttatgttgatgttatcagtcctttaggtgctcgtattcaggtccaaggctccccgctttatttacagcaattaatgacacaaaatcgtattcgagcttgcttgttgaccggtattcgttcggcggtactttggcgacaagttggcggtacgaaatggcaatttttgttttcacgtcgcaagctggtagcaacagcacaacaaatttattcatctatttaactgttcttaggagtaattcttttatgcaattcaacgcattgaccgcactttccccgatagatggtcgttatcaagacaaagtaactgctttacgtagcatttttagcgaattcggtttattgaaatttcgtgtaactgtcgaagttcgttggttacaaaaattatctgcaacaggcactattcaagaagtttcttctttatctaaagaggcaaacgattacttaaatcaattggtagaaaatttcagtttgcaagatgctgaacgcattaaagaaattgaacgtattacaaatcatgatgtaaaagcggttgaatatttcttaaaagaaaaaagtctggcaatacctgaattagtggcgattagtgagtttatccattttgcttgtacttcggaggatatcaacaatctttcttatgcgttaatgttaaaaaacgcacgtgatgaagtacttttacctgagtggcgtaagttaattgatgaaatcactcgccttgctacagagtataaagcaattccattattatcccgcactcatggacaacctgcctcacctaccacaataggtaaagaaatggcgaatgtggtatatcgcttacaacgtcagtttaaacagttacaacacgtggaaattctaggcaaaattaatggtgcggtaggaaattacaatgcccatttatctgcctatcctgagattgattggcatcaatttagccaagaatttgtgacctcattaggtttaacttggaatccttatacgacccaaattgaacctcatgattacattgcggagttttttgataatgtagctcgttttaacactattattatcgattttgaccgtgatttatgggggtatattgccttaaatcatttcaaacaacgtactattgccggtgaaattggatcgtctaccatgccgcacaaagtgaatccgattgattttgaaaattcagaaggtaaccttggcttagcgaatgctgttatgtcgcatttaggtgcaaaattaccgatttcacgttggcaacgtgatttaaccgactcgacagttttacgcaatttaggtgtggggcttggttattgtttaattgcttatgcggcaacattaaaaggtatcagcaaacttgaggtaaatgaaccgcacttacgtgaagaactaaatcaaaattgggaagtgctggctgaaccaattcaaactgtgatgcgtcgttatggtattgaaaaaccttatgaaaagctaaaggagttgacgcgaggtaagcgtgttaatgcagaggcgatgcgtgagtttattgagaagttggaaattccagctcatgaaaaagctcgtttaaaacaacttacaccggaaacgtatatcggtagtgcaattagtttggtggaaaaattgtaaattcggtgtgtttgtcttggctattgccccttagtataaaagcgtatcttagctacgtaaggggcaaatttaagacacttcaggtaagatttaattcaaaaatagacttttgccggttaagtttaaaaccttctcttattaataattccggttgttgcagattttgttccatgactaaaagtgtcgattgagtataactgacaaattcttttgcttttgcaataagtgcggtgtaaatttcactcttattttgggtatttttgacaaaaatatcatttaattgccaataacgttgcagttgtaatgaagaaaagcgaggatagagttgaataaagccgacagggttttgctgattatcgacggcgagaaagaagatactttcactaaatcgaattcggtttgataaaaaaataagagttcgctccggattttctatcatattatgggtgaggcggtattgttcaaataaagacaataaagcgtccaaattccatagttcagctttaaatattttcatttctcaataattgttcaaaatttatgaaattcatacagtagattttatctttttaatacaaaataatcatcttttatgaaaaattttttatggatacaggaaaatttttgcaaaaaagagtatagtactgacagaatttttttattaattattatggagaacataaaatggctcgtcgtcctttagtcatgggtaactggaaattaaatggtagtaaagcctttacaaaagaacttattaccggtttaaaagatgaacttaatgcggtgtcaggctgtgatgtggcaattgcaccgcctgtcatgtatttagcggaagctgaagctgcactggtcagcagtgatattgctttaggtactcaaaatgttgatttaaacaaacaaggtgcatttaccggtgatatttcaacagaaatgttaaaagactttggtgtaaaatatgtcattatcggtcattctgagcgacgtcaatatcatcatgaaagtgatgaatttattgcgaaaaaatttggtgtgttaaaagatgctggtttagttcctgtattatgtatcggtgaaagcgaagctgaaaatgaagcaggcaaaacggaagaggtttgtgcacgtcaaattgatgcggtgatgaatacactaggtgttgaagcatttaacggtgcagtaatcgcttatgaaccgatttgggctatcggtacaggtaaatcggcgactccagctcaagcacaagcagtacatgcctttattcgaggacatattgcaaaacaaagccaagccgttgccgaacgggtaattattcaatatggcggttccatcaatgatgcaaatgcagcagaattgtttactcagcctgatattgatggtgcattagttggtggtgcatcgttaaaagcgtcagcgttcgctgtcattgttaaagcggcggcgaaagcaaaaaactgattttagttcattcataaaaagtgcggtaattgataccgcactttttagtattcatattagtattcataatttctcgttttcttaatgtctaaaatttatgtggtcttttttttatacctcaataatgtactgtattcagccatttgtcttggtgtataaccttatacgcagttttaagtcgccgaattatcgaaaacgtattttagaacgttacgctttttatccttcgctgactgaaccgaagccgaatggggttgtgattcatgcggcttctgtgggggaagtgattgcggcaactcctttagttaaaaagatacaacagcaatatccacatttatctataacgtttacaacggtgacaccaacgggatcagatcgtgtcaaagccgcttttggtcaatccgtcttccatgtttatttaccttatgatttacccgatgcaattttgcgttttattgattttgtaaaaccgaaaatgtgcattgtgattgaaacggaaatttggccgaatttaattaaacaattatatttacgagatattccttttgttatcgctaatgcaagattgtctgaacgttcggcaaaacgctatggctgggttaaagcacaattacaaaatatgtttagtcagattagcctgattgcaccgcaagacgaggtaagcctgcagcgttatattgatttgggctacaatccgtcaaaattaaaattgacgggaaatatcaaatatgacttagtggtgaatgatgaattagtgcaaaaaattaccgcacttcgccaatcttggagccaaaatcgcccagtttggattgctgcaagcacccatgagggcgaggaaatgattattttgcaggctcatcaaaagttgctaaaaacttatccgcagttgttattaattttagtacctcgtcatcctgaacgttttaaccttgtcgcagagttaattgaaaagcaaaagcttaactatattcgccgttctgcacatgttaatcccgatttattaacacaggttgtacttggagataccatgggggagttgatgttaatgtacggtatttccgatattgcctttgtggggggaagtttagtcaagcatggggggcataatcctttagagcctctcgcttttaagttacctgtgattagcggtcaatatacttttaattttccggtggtttaccaaaacttatcagaggttcaaggggtagtgttagtcaatgaaaatagccaagagctggaaagtgcggtaaaaaatttgttatcttctcctgaattatgtgaacgctatggtaatgccggttatgaagtattggtccaaaatcgtggtgcattacaacgactatttgaattactacagccttatttggagaaagaataatgacaacggttatttatcctggcacttttgatcctattaccaatggacatatggatattattcagcgtagtgcggtcttatttagcaaagttattgttgctgtggcaaaaaacccgagtaaacaacctttatttaatttagctgagcgagttgaattagttcaattgtctgttgttcatttagacaatgtagaggtaattgggtttgatgatttattggcaaatgtggttaaagcaagacaaattgatgcgattattcgaggggtacgcacgacaatggattttgaatatgaatcacaacttgcacatttaaatcgtttgttgacgaatggtgtagaaagtttatttttacccccgaccgagcagtggtcttatgtttcttcaactattgtacgagatatttttttacatcaaggtgatgtgtcccgattagttcctgcagcggtattacgagctttagaaaagcgggctaaataatttgatgagattttattaaataatccttacattatgtatgtttaaaacactaaaactaaataggaaataatgaatgttgaataaaatttttgtgtggtttgaaagtcgtttaaatccttatccggaacagacgttcaatcacctacatcaaggtctgtttcgatttatttggtcaaatttggaaggaatgaaaaaatggattttcctacttgctttcttatcgttcggattgggggcaatggaggcaattcttttccaatttatgggcgttttggtggaatggctcagtcaatatgacgtgcaaactttatgggtagaaaaaggtgcttatttagttgggatgttgattttattgctatttagcattatatggtcttttttagcatcagctacacgtttgcaaaccttacaaggtgtttttccaatgcgtttgcgttggaattttcatcgtttgatgttggggcaaagtttaagtttttatcaagatgaatttgccggtcgagtgtctgcaaaagtcatgcaaacagcgttggcattgcgtgatacagtgcttactttggcagacatgatggtttatattttggtctattttgttacctcaggtattgttttagcagcattagatatatggttattagttccttttgttctatggctaatagtttttgtggttattttatggattgttattcctgaattggctaaaaaagcagaacaacaagcggactcaagatcattaatgacaggtagaattactgatgcttatgccaatatttccactgttaagcttttttctcatggtgcaagagaggcagcttatgcaaagcgatccatgcaagattttatgatgactgttcatgcacaaatgcgtcttgctacttccttagatactctgacttatagcacaaatgtagcgttaactttaagtacgggaattctagggattgtgttatggggaaaaggtttggtcggtgtaggagccattgctactgcgttggcaatggcactaagagtgaatggattatctcgttggattatgtgggaaatggcacgcttgtttgaaaatatcggtactgtaaatgatggtatgtcaacactgacaaaaccgctaactattgtggataaaccggacgcacaagatttggagattaaacaaggaaatattcattttaataatgtagactttgcttatacaccggataagcctttactaacaaattttaatttacatattaaagccggagagaaagtagggctgattggtcgttccggagcaggaaagtctacaattgtaaatttattactgcgattttatgaaactcagcaaggttctatcactattgacgggcagagtgtcgcagatgtttcacaagaaagtttacgtcgccaaattggtttggtcacacaagatacttctttattgcatcgttctgttcgggataatattgtttacggtcgtccggaagcgacagaagaagaaatggttgaagctgcaaagcgagcagaggcggcggagtttattccatttttgagtgattctcaagggagacaaggttatgatgctcatgtgggagagcgaggagtaaaactttctggggggcaacgtcagcgtattgctattgctcgagtgatgttaaaagatgcaccgattttgttactggatgaagcaaccagtgcgttagattctgaagtggaaatcgctattcagaatagtttggacaaaatgatggaaaataaaacagtgattgccattgctcatcgtttatccacaattgctgccatggatagattaattgtattagatcaaggacgaattgttgagcaaggcactcatactgaattgctggagaaaaacggtttgtatgcaaagctttggcaacatcagagcggtggatttttgagtgaatattagtcaagattttaggattaatcaaagacactaaaaaggcggaaatgtaagatttcaaattccgccttttgctcctcaaacagtgttatttaaatttgtcggcataagcagagctgttgatccactgatgatcttgttcccaagtaaatttccatttacgtacaggtcccgccataacattaaggtaatagttgttataaccggcaatagtggcaactgggtgataaccttttggtaccagcaccacatcgccatcatataccgccatacattcgtccaaagtgcggtcgtccgtatagacacgttgcagagcaaaaccttgtggtttatcaaaacgatgataataactttcttctaagtaagtttcatcaggactatctttttggtcatgcttgtggcttgggtaggaactggtatttccttcatcagtaaatacttcaaccactagcaaggcatctgccttttcggtttccggcaagatattgtgtacaaggcgtttgttattaccaaaaccacgtcgttctactcccacttgttcaggggtaattaaacgtacaggcaagtcaccgttacttggtgctcgacaaacagccaactctaaataagtttcagctttaatttctatttgttgatggtgtggagcgtacaccgaataaggcggaattttctcaaacggtgtagttcgattaccaatattattatatgtttcaccgccagctgagacagtggctttaccacttactaaaacaaaacaagtctcagtagtttctgtattaaaacttaatgtctgccctgcttgcaaatgatacatttcaaaaccgacatattcccaacctgcactttccggtgtgattttttgtacttcaccatttgcagcaggattgtctttgcgtgatttagataataaataactcatattttccccgatgtgatcatattgataagatttagctgaaatcataccgcactgcgtaaatttcgctatgagaaatatagaaaaatcagagatagatcacaaaataattattttacttctattagaatttgataaaaatgttttatttatgattttttttgcagtatataaactaggcgttttataagatttagtagtatagaaatctttgttaattaaaaataaaggagttttgtatgaaaagctttttgcaaaaatatgggtttaccccagcctcattttttcaactcattctgatcactgttaatgcacaattgatttatgctttttgggatattcgtaatagcgtacccggtggttttcctgccgctttaggggtaacggatcaacaagccggttatttatattctatgcaaggacttgtgattattttagggactattgctttaggttgggttggtgaccgtttttcaattcgttctattatgttgctatctacggttggtgtgggtggaatttctttatttctaaccctctcatctccgggacttagcatgcctgtgttactggcttgtttcttctctatgttattttttagtgaggtattatttaaaccggctaatttcaaagcattaagaatttcaaccacggaaaaacatcaaggtatggtatttggattatttgagtttggtcgtgggttgcttgctttccttatctccttgttatggacggtgatgctttattataaagtcggtccgaaggcaatgatgatgacaagttgtattattgttattattactggtattgcagtgttttttattgtacctaaagatcaaaaagtcggagatgaagatactcaagttaatacgaccaaagaagctattcagggtgttgctcgtgtagctaaattaccggttgtttggattgccggaattaatgtgttctgtatttatggtgcgtttgttgctgctgggacctattttgcccgttttttacaaggtggatatggtacaagtgcggttgctgcggcagtttttgcaacagtagttattgcattgagaatgttacctttggtttcttccgttttagtagaaaaagtctttgcttctaccgcacacttcatgcgaatgatgcaaattattttagtggttattctttctgtaattggaattatcttttttaccaatcatccagatatttctttatatgcagatggttatattccggataataccccggtaggactcatttcttccagtatgttctggacactggtagttcttatgttatgtgcatcagcttgtatcttcatgattcgaggtgtttattatgccccaatcggtgagatgggggttgataaaaagcattcctcagcagcaatgtctttcgccattactattggctattttcctgctttattagcaccaattgtattaggtggcttggttaaatcaccggcaaaagatgctacaggacaaattatccgctcttatttaactgatacgcaagtgttagcttgtgctttctttgggcttgcgattcttgcgttaatttctgtttttatgtcacatactttaattaaaatgaaacagaaacagcaattaaaaactagtaatcaataggcggttttttatgaatggtcaaaaaataataggaagtcagtgtattacgcaatgtaatcccgatcttcgcattaccgaattgattattccaggaactcatgactctgccacatcaacgtgttatgaacgttattatcgaacacaggatttatcaatagcggagcaattggattgcggtgttagatttttagacattcgtttacgcaaagaaatggttgcagcccatcgagaatgggttagtgatattcgagcagaggaaatttttgaaaagtgcggtgagtttttacaaaaaaatccacaggaattcgttttaatgcgtattcaaaatgcaaatgaacggaaagatgattttcctgaatatggcgaagcgttgttgtcaaaagtacagcaatataaatctttgttttatgcttgggagcattctcaaattgttcaagatggcaatccaaaatggccaactattgcacaagcggctggaaaaattgttccgatcgaatgtgctccgccaagtatgtcaattaacaaaataaacggtgaattatgggcagccaattggcatgataattcgcagattttgttacaagacttgtgggatggtccgacagtagaagaaaaatgtgtggcaattaaaacgctgattgaaaaaggcagagaggtacactcggacatactgttgttaaatcatattagtgcgactaatggtgaattgcagtatccggatgcttatgcagcatatttgaatgaatactctagtcgattatggaaacaattggcgaaacgtagttttagaggtgtgcagatttatgattttattaatccttctatctgccaagaattgttgcgattaaattttgattagttgagttgatagatttagcaaaaatcaaatctagatcacaaaaatgaaataaatatttcgttttcaataaaatgaattgaaaattttattccattgatctactctaaagacgtagcaagaaatgctttgtgattgagcaaaaatacttaaggagaaaataatggaaacggttttgaactttatcaatggtaaacaagtagcaagtaaaggtactaaagcttggcctatttataatccagccacgggtgagcaaattcgccaagtaatgatgagtactgcagaagaggtaaatgaagcggttgaagttgcacaaaaggcatttcctgcttgggctgcgacttcgccacttcgtcgtgcccgtgtaatgtttaaatttaagcaattgttagaacgtgattgggatgacttagctcgtttaattaccgaagaacatggtaaagttttctctgatgcacaaggtgaactaactcgtggtttagaagttgtggagtttgcttgtggcattccacatttagtaaaaggtgaattttctgaacaagccggtcgtgggattgatattcattcagccatgcaacctttaggagtttgtgtaggtatcacaccatttaattttcctgcgatggttccaatgtggatgtttccgattgcacttgcttgcggtaatacatttatcttaaaaccggcgaaagccgatccatctttatctattcgtttggctgaattattaaaagaggcggggttaccggatggtgtgtttaatgtagtgcatggtgatcgtcaagacaatgaaattttattgcgtgatcctcgagtgaaagctgtaagctttgtgggttcaactacggctgcggcacatgttcatgcgattggttcggcacatggtaaacgtgttcaagcactgggtgcggcgaaaaatcacggtttagtgatgcctgatgtagatattgaagcaacagctaacgcactattaggtgcggcattcggtgcagccggtgaacgctgtatggcattacctttagcagtaaccattgatgatgaaacggcagataaattagtcgcagcattaaaaccgaaagtagaggcattacgttatggtcccggtctcactaaagaaggcgaaaaagaaaatgattttggtccattaattactcgtcaacatcgtgataacgtaaaacgttatgtagatataggtgtgtcagagggggcaactttagtggttgatggacgtgataaattccctgctggttacgagaatggtttctttattggagggtgtttatttgaccatgtaactcctgatatgactatttacaaagaagaaatttttggtccagtattaggcattgtccgtgcgaaaaatttccaagaggctatgaaactaattaatgagcatcaattcggtaatggtgcagcaatctttaccaataatggtgcggcagctcgtgaatttgcatatcaagtacaagcaggtatggtgggcgtgaatgtgccaattccggtgccgatggcattccattgtttcgggggatggaaagaatccgcttacggtgcattaaatgcttacggtccagacggtgttcgtttttataccaaaatgaaaactgtaacaacacgttggccagagaaagatctttcatcacaagcagcattcagtatgccaaccctataaactagacaacagaataaaaatttaagttaatgtaaagaagatagttttttagctatcttcttttgcaagaaaaggaaatgaaaatgaaaaaagtccgagtcggtttaatcggaacaggttatattggtcgttgtcatgcgattgcttatgcacaagcaccgacagtttttcctcttgaggctgaattggttttggaatatttagctgaaatcacaccagaactggcacaacaaaaagcacaagaatttggttttaatcgttcgacaggtgactggcgagatgtagtatccgatccaaatatagatgttgttgatatttgtacacccaatttcttgcacaaagaaattgctttagccgctattgctaatggtaaacatgtttattctgaaaaacccttagcattaaccgcagttgatgcaaaaatcatgtatgaggcggcaaaaaaagcaggtgtcagaacccttgtgggatttaattatattaaaaatccgactacacaacttgctcgtgaaattattgagcgtggtgaaattggtgaagtaatccatttctatggtacgcataatgaagactatttagcatcagatacgacacccttagactggcattgtgttcgtgaaaaagcaggacttggtgcattaggtgatttggcagcacacattgtgcaaatgtcacaatatttagtaggtagcgatattgaaaaagtgatcggtgatatggagacggtagttaaagaacgcccaaatccccaaaatcttgcagagcgtttaccggtagaaaacgaagatcaagcaactgctatggtgcgttttgcaaacggttgtatgggaaccattgaaacgtctcgtattgcttgtggacgtaaaatgggattgacttatgtaattaccggaacaaaaggtacaattacctacacacaagaacgtatggcagagttaaaactctatcttcacgatgaagatccagctcgtcaaggctttaaaacaattttgacaggtccgttacacgcagattataaaaatttctgtgtaagtgcgggtcatggtattggttttaatgatcaaaaaacggttgaaattcgtgatttagtgaatggaatagcgaataatcataatatgtatcctgactttgaagaaggttttaaagtttctcgtgtattagatgctattgcacaatcttgccaagaaagacgttgggttaacgtgaaagaaattgcgtaattttcaccgcacttttataagtatttaaaaaggtcgagttgaatgactcggcattttttaggtataaatttaaaatgttgtttatctctaatttttaaaaatttttccctcaaaaagtagatcttgttcacaaaattttaacttcatcattgctctgtatcttgataaatgttacatactgttttaaacaatttatttcaaattgttttatttttggaatttatatttcttcaagtggaatatagctgtatttcagaatagtgattaactcaactttccaggagtagcgttcttatgaagaaaacattattggctatgttatgtggcggtctattattaacctctcaagctgtaatcgcaaaaaattatgtcattggtgcacctatgaactcttttgcggataaatggcaaacttatcttcaagatgccgttcgtgattttgatgaaaaacatgatgatgtgcaaatcaaattggctgattcaaatagcgatcctaatattcaagtcaatttagttcagaattttatcgaccaaaatgttgatgcgttacttgtggttccaaccgatccgacagtagtaaaacgtattggcgtgttagcaaaaaaagcgggcattcctttaatcgtggtgaaccgtaaaccaaatgatgagcatatgcaatatgtaaccagctttgttggttctgatgaaattgaaggggggcgaattcaaggtaattttattgtcaatactctagccggtaaaaatgcagagagtctcattttactcggaccattggggcaagatgcagtcactaaacgtactcaaggtaatgaggaaatttttgctcagcacaagaatattaaagtagtgagcaagcaagaaggtagatgggaacgtgaccgtggtttagctattgcagaaaacgtattggcggggaataaaggtattaacgttattgtgagtaacaatgatgaaatggctattggtgcaattcttgcaactcgtaagttaggtatcaaagacgaagacattactatcgttggtttagatgcaactcccgatgcgttagagtatttaggtaaaggtttggatgcgacagtattccaatccgcacaaggtcaaggttacaccggagctgaaatggcttatttagcggctaaaggtgaaaaagtaccaagcgttaaatgggttccttttgagctagttactccggataaaaaagaagaatatcaagcaagatataaatagacgcttcttaaccaacacaaagggtagtgtaatacctaccctttatcttgagcaaatgttgatcgttatcatctagagacaaagttatgttcaaaaaatcattgtttattttattgggagtagcgtcgttgttttcccccattgttacggcaaaaaatttaaccgttggcgtggcgatgtatagtctttcagataaatatcctacctatttgcaagatgctatgaagaaatttgatcaggaaaaagctgatgttacttttcgttatgctgatgcaaattcagatccggcaagaatgttaagcgatattgaaacatttattgattctggtgtagatgctttgttagttatgccgacagatagcgatattattaaagctattggtgttaaggcaaaaaaggcaaaaattccgttagttgtggtgacaaataagcctaaagatgaggatatgaaatatatcaccagttacgtagggtcagaagagattactggtggtgaaatgcaggcaaactttattgtagaacaattaaaaggtaagccggcaaatgcgattattttaatgggacctctaggttgggatgctcaaattaaacgcactgaaggaaatgaaaatattctgagaaaacaccctgaaattcaggtgatcagtaaacaggaaggtaaatgggatagagcaaaagcaattgatattacagaaaatttgttatcaggtagtcaaaaaattgatgtagtgatcagtaataatgacgagatggcaatcggtgcactccttgccgcccgtaaaaaagggattgcagacgaggatatgttgattgttggattagatgcaacacctgatgcgttagagtatttaggtaaaggtttggatgcgacaatttatcaatctgcttccggtcaagggcgtaccagtgcagaaatagcgtataaagcggcaaaaggtgaaagtgtacctaagttgaactttattccttttgaattggttacaccggataaaaaagcacaatatattgataaatatagatgatagaaaacagtaaaaattaaccgctctttgttgttagaaattaccgttattaatacgacaataaaaataaggagttctaaatgaatgatttgagtcgttctccatatattttagatatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggtggagaattaattttagatgataagccttttaaaccgagtgcaccgattgatgctattcgcactgggttgactatggtaccacaagaaatttctcctgcgggtaatttaactatcgcagataatttctatcttgggcgagaaattactcgtggtaaattctttttaaatcaaaaagaaatggattgtaaaacagcggaaatcttaaatgaattgggtattccgatggatgtaaccgctaaaatgtcagatgtttccgtagcgaaggcacaattggttgcgattgctaccgcagtttctaatgatgcgaaagtaattattatggacgaaccgacaacggcattaacagaagtagaggttgaacagctttataaaattattgaaacggtaagacaaagagggatttcaattatctttatttcacataaattagatgaagttttccgtgtttctgatgaaatcacagtaattcgtgatggtcaatatgtaggtacgaaactaacctcagaagtaaccaaagatgaattgatttctatgatggttggtcgtgatatgtcagaaatgttccaacgtgaacgtattgttatttctgatgaggttgtactcgaaattaaaaacttctctcgtgcaggcaaatatcatgatattaatttccaagtgcgtagaggagaaatctttggtattgccggtctagtcggtgcaggtcgttctgagattgtagagggattgtttggttataaattggctgatagtggtgaaatctatgttcacggcgaaaaagccgatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgactcaagaacgggtgcttgaattagcatccggtttaggtcaagtataaaaagatttcccctagaataacaatcgaggtatttattatgtcaaatgctacgcttaaaaaaatattgaacgcctatggaatggtgtttattttaattgccttatttttagcattatctgcatcaattgatggtttcttttccgctcgtactgtttggagtattattgagcaagtttctatgtttgggatcattgcaattggagtaacctttgctattatcacaacggggattgatttgtcctctggttcaatggtagcgatgacttctgttgtggctgcttctatcgtaactggtggcgatacagtaagttcggcattacttgcttttgcgatttcaattgtattaggtgctgcaatgggggctatcaatggtagtttaaccgcttttggctctatccctccgtttattgctactttaggtatgatgattattgcccgtggtggtgctcaactttattcttcaggtcgtccaattgatgcctcttctgaagcatttacttggatttctgatgttgatttctttggattacccggtttagtacttgtttatatcgtaattgtcattgcttcacacattttactgagccgttcaacatttggccgtcacgtttatgcagttggtggtaatttaaacgcagcaaaaatttgtggtattaatacaactaaaacattgatttgggtttatgttttcgccggtgctttgtctggattagtgggggcattactagcagctcgtacttatgcaggtaacccctcttatggtttatcttgggagcttgatgcaattgccgcagcagtgatcggtggggtatcgctaagtggtggtattggtacaatccctatgtgcgttatcggtgctttaattattgggacaacaaacaaaggattaaatatgctgggagttgatccatattggcaacaaattattaaaggtttgattattgttgttgcggtattaatcgatacattaaaacgccgtagaaaagcaaattaagcaaaaggttacaagaaaaaaatagcaattgtatagttgctattttttttgtttgttggggaagtgcggttagaaaaatttgatcagctccacaaaaatgaaatttatttttcatttttattttatttgaaacgaaaatatgattatatagctacaaatttcaattatctgatttgggagatgatgatgaagacagtgagattaacggtagctcaagcattagtaaaatttcttgataaccaatatattgaattcgatggaaaggtaacaaaattcgttgaaggcattttcgggatttttggacatggtaacgtgctgggtttaggtcaagcactggaacaggatagtggcgaattgattgtgcgtcaaggacgtaacgagcagggcatggctcacgtagcaatagggtttgcgaagcaaaaattacgcaaacaaatctatgcctgtacttcatctgttggtccgggggctgcaaatatgattacagcagctgcaacagcaacggcaaaccgtattccacttcttttattgccgggtgatgtttttgctactcgtcaaccagaccctgtgttgcaacaaattgaacaaacttatgatttaagtattagtaccaatgatgcttttcgtgcggtaagtaaatactgggatcgtgtaagtcgtcctgaacaattaatgacagcttgtatcaacgcaatgcgtgtattgactgatccagcagaaaccggtgcggtgacaattgcattgccacaagatgttcagactgaagcttatgattttcctgagtattttttacaaaaacgtattcatcgcattgagcgtacacctccaacggaagcgatgctacaagatgctttgaccttaattcaaaatgcgaaaaaaccactaattatttgtggtggtggagtgcggtactctgaggcggcagagcaattaaaagcctttgctgaaatttataatattccatttgcagagactcaagcgggtaaaagtgcggtagtttctgagcattatttgaatgttggcggtataggtgtaacaggttgtgtagctgcaaatttattagcaccggaggctgacttagtcattggtattggtacaagatatactgattttacgacgggatctaaatggattttcaataatgacgaagtgaaattcttaaatatcaacgttgctcgctttgatgcttataagttagatggtgtacaagttacagctgatgccaaagaaacgctagaaaaattaaccgcacttttagctacaacaggttatcaagcccaatggggtgataaagtggcacaggcaaaaaaagcgttggaaactgaattagagcgtgttcacaatataacttataccgaagattttgtacctgaaattgatgatcgtttaaatcgtgaggcggtttatgctgaatttatggagatgaccaaatcttgtttagctcaaacaagggtgttaggtattttaaatgaaacattaggtgaaaatgatgtcatcgtgggggctgcgggtagtttaccaggagatttgcaacgtatttggcagtctaaaggcgaaaatacctatcacctcgaatatggttattcttgcatgggttatgaagtcaacgcggctttaggtgtcaaagttgcggagcctcatcgtgaggtttatgccttattaggtgatggatcttacatgatgttgcattctgaactggtaacgtcaattcaagaaaatagaaaaattaacgtaatattattcgataatatgacaaacggttgtatcaataacttacaaattggccatggtatggacagttttgcaacggaatttcgtttcagaaacaagaataccaataaattagatgggggctttgtaccggttaattttgctatgaatgccgcatcttacggttgcaaaacctatcaagtaactaccgaagaagagctacgattggctttggctgatgcaaaaaaacaacaggtttctactttaattgatattaaggttttaccaaaaacgatggcgaagggatatgaaagctggtggcacgttggtgtggctgaggtgtcaaataaagctgaaattaatgctgcctatgaagattctgttgctcatattgaggtagcaagacgttactaatttaacttgataggctcaatattgagcccatttatcatgaaattcattcattctttttaagaaggacaacagtatgaaagctgaaaatgtaaaattgggcattgcaccgattggttggacaaatgacgatttaccggaaattggtaaagagaatacttttgaacagtgcgtaagtgaaatggcattagctgggttcaccggtagcgaagtgggaagtaaatatccacgtgatattgacgttttgaaacgtaaactggatttacggggtatccaaatttgtaacgcatggttcagtacattctttgttgatggtaaaaaagaagaaactatcaaaggttttatagagcatcgtgattttttacatgctatgggcgctaaggttattggttgctctgagcaaagtcgtagtattcaaggtcagaaaaaagcaattttcaaagagaaaactattttcacggaagctgaatggcaattgctagcggaaggttataatgagcttgcaaaattagccgcagaaaaaggcatgaaggtatgcttacatcaccatatgggaactggtattcaaacacccgcagaaattgataaatacatggaaatcactaatgatgatgtgtatttattattcgattcaggtcacctttattattcagaaggctcacaacaagttatgttggaggtattagaaaaatatattcaccgtgttgttcatgttcacctaaaagatgtgcgtgatgaggttgtggcggaagtaaaagcaaatgatcttagtttcttggaaggggttgttaaaggtacattcactgtgccaggagatggtgtaattgatttcaaaccgatttttgatattttagaaaaatatgattataaaggttggatggttgttgaagccgaacaagatccggcaattgcaaatccgttagaatatgcaattaaaggtcgtcaatatatcagagaagttgcaggagtttaaaatgattaaagtaggtattattggtgcaggtcgtattggtcgtgtacactcagaaagtattacaaaatatgtaaaaggtgctgaaatcaaagcgatttctgatgttcgtgttactgaagaattaaaagaatgggcaaatggaatgggtattccgaatgtctatgaagactataaattaattttacaagatgcggagattgatgctgttttagtctgttcttccactaatacgcatgcaccgatttctattgaagcggctcgtgcaggtaaacatattttctgtgaaaaaccaattgatgcagatgttgatcgtattcagcaagtattagcagaagtggaaaaagcgggtgttaaattccaagtcggttttaaccgccgttttgaccataatttcaaagcaattaagaatgcggtagtcaatggtgatattggtgaaccccacgttattcgagtcacttctcgtgatccagatgcaccgccaattgaatatgtaaaagtgtccggcggtatgttatttgatatgacaatccatgattttgatatggtgcgttatttgtccggcagtgaagtaacggaggtgtatgcggcaggaggtgttcttgttgatccgaaaattggtgaagcgggcgatattgataccgcagttattaccttaaaacttgcaaacggggcaattgcagtgattgataatagccgtaaagcagtttatggttatgaccaacgtgcagaagtattcggttctaaaggtgcgatccaaaccgcaaatgatacgccgtcaacagcaattttatctaatgtgaatggtgtcatcgcagaaaaaccaaaatatttcttcttagaacgttacatgcaatcttttgctgatgaaatggcgtgctttgttgactcagtggtgaatgacaaaccaacattagtaaacggtactgacggtttgcaaccggtattaatcgcaattgcagcgaaaaaatcattggatgaagggcgtcctgttaaaatgagtgaaatttcctagtttaaggagattgcacgaaaaagggcggtaaaattaccgctcttttagtttgtacttctgttacgttgccaaatctccgaaacagacctgtaatgcggtgattgcactaagtgcggtagtttctgtacgtagaacacgcttaccaagtaaaatttcagtaaatccctgagtttctgtttgactaatttcttgtgcagaaagtcctccttctggacctattaacaagcgaacaccttgtgggggaatttccggtaaggtacgaattgtatatttagctcttgggtgaagattaagctttaaggttccgtcttgttcagcacaccaatcttgcaatttcattaatgggcgaatttcaggcactatattacgcccacattgttcacaagcggaaatcgcaattttttgccattgttggatttttttctccatacgatccttatcaagttttactccacaacgttcagaccataatggcgtaattatgttgacccctaactcaacggatttttgaatagtaaactccattctttctccacgagaaatcacttgacctagatgaataaataatggactttcacgattgtccaattgacgagagagaatgttaacttcaattgcttttttatttgtttgagtaataatggctgggtaaatatggttacttccgtcaaataattcaatttgctcacctacctgcatgcgtagaacacgccctacatgatttgccgcatcatcgcttaattgacaggtttgttgattttctaaagaggttggatgataaattcgaggaatacgcatattatttaatgggttagttaattttgttgctatgataacagaaattaaaagtgcggtgaaattcaccgcactttttgtcattgtatttgttgacttgaaaaaataagtaattttaccttatttttttatatcaaatttataagaaataaatccatatagcgtccaaccgatgaatgttacgattgatccgtatagcatagcttgctcacctgctgcgtataaggcatataaactatataacgaaccgatgaaggcaacaaatgtggtaattttagctttatttaatgctactttttctactttaagtaagaccattaatgcagccattgataacagataaggtattacgttggtcaccaccgccaagtctaccaagatgttaaattgtttgtttaaagatggactgatagtcatcagtgctaataaactttgaattgcagtaattgtaaccataccaatgataggtgcgtttttactggtcacttttttgaagaatgctgggaaatatccttcttcggctgaagatttgaatacttgagcaatggtaaactgccagcctaataatgaaccgaagcaggacattaccattaagcccattaccactttacctgttgtttcttcaaacatatgtgcaaaagctaaaccgaacggtgctgttgaattagcaagttccaaattaggaacaataccggcaattacgttggtggaaacaatataaataaccgccgcacctaatgttccgccaagaactgcgataggaacatttctttcaggattttctactacatcagtattcgcacaagctgactctaaacctaagaaggcccataacgtcatagaaatagatacgccgatggcttcaaaagtgggaacgttatgtgggttccaagcactgacatacatttcaccactaaaccagaaccaaccaattaaacaaatccctacgaccggaataattactccccagatagtaaaagagctgatgttaccagtgattcttgctccaccaaaattcaaaacagttgctaaccatagtgtgaatatagtgcatagtgcaatggatatcggtgataaagtgacatttaatagctctgatccgtatccaacggcggatattgcaatcgcagtattggcaatgactagagaaaccccataagtgtagtttgccataaagttaccggctttaccgaaagaatattccgcataaccacccataccgcctgattttttactgaacataccacattgagcaaaagcataggctaaagcagttgaaccaacagctgtgactaaccaagatacaattgagatagttccaatttcagctaattttgtcggtagcatgataatgcctgaacccatcatatttaccattgtcagtatagtgagttgtactacaccgattttattacttttttgagtactcataattttatccctctattaaagtgcggttatttgtaattaaccgcacttatttttttattatgcttcagttaatacatatccataagcacgtgtacgtccatcaggatctttttgtagatatacgccctgaatttccggtgcgaatccaggaagaacattaatgccttcttccagtgcaaggaaatattgttgtactgtcgtactccaacgttcaccgggaacaacacataaaacacctggagggtaaggtaatgcaccttcggcggcgattctccccacaatatctgtcaatggaactaattcaattttgttacgaacaaattcgatattcgctttttgtgggttcatagcatattccggtagagttgtttttctaaacaagtcacgttgtagctgtttaacatttctactgacgtaaagattgtgcatttcttgacataattgtctgatagtgtagccctgatagcgttcctcattatttttgtacacagtaggcagtacatctttgagtaatgagttttgtttgatatgtttttcaaacgcagctatttgagcaactaaagtttgcatttttgtcaatgtttcagccggtgtaagcaagaataaaatggagttcaagtcacatttttcaggaatgattccattttctcgcaagaagttagcaaggattgttgctggaataccaaagtcttcatattcccctgtttcaatgttaatccccggagttgtgagcatgaatttacaagggtcaacaaaatattgattatctgtataaccctcaaatttatgccatgtatcatttgcatggaaattgaaaaactcaagatcatttgcaatttctttagtatcgtgatcttgccattttttacctttcacataaggaggaataaatggtttgattaaagtgcagtgcttaagcattaactttcttgcctcgataccaacttctacacactcggcccatagacgtttccctgcaggagaaccttgaatttgagcgtttacatccagagtggcgaatagaggatagaatgggctggtagacgcatgcaacataaaggcattattaaagcgtttgtgattgcaatatcttgcttgtcctttaatatgtttgtcttttttatgaatttgtgatgtttgtgagaaacctgcttgttgtttatgtaccgattgtgtcacgataataccagggtcattttcatctaaatctagtaataatggagagcaatctttcatcattggaatgaattgttcatagccgacccatgcagaatcgaacaagatgtaatcgcataaatgtccaatacgttcaacaacttgtttggcgttataaattgttccgtcataggtacccaattgaataattgcaagacggaaaggacgtttctcttcaagtttttccggtgccacttctgcgattaattttttaagatatgcttcttcaaaacagtggttatcaataccgccgatgaagccgaatggattacgggcagtttccaagtaaacaggggttgcacccgcttgaattaaagcaccgtggtgatttgatttgtgattgttgcggtcaaataatactagatcacccggtgcaagtagtgcgttacaaaccactttattggaggcggaagttccgtttagcacaaaatatgttttatctgcattatatacttttgctgcatgttgttgagcatcacatggagcaccctcatgtattagtaaatctcccaatttcacatcagcattacaaatatctgaacggaaaatattttctccatagaaatcgtatagataacggccggctggatgtttgcggaaatattgaccgccttggtgtcccggacaatcaaatgccaaattacccatttcgacatattcgcttaacattttaaagaatggaggtaacattttttgctcataaagagacgcagctgtttcaatttgacggctatacaaattgatatcatagctgtttagatcttgaacatgataaacctgatcaaaatattcatcagaaagtgtttcaccttcatttaatacgacaaaaataggaatattaaattcagtcgtttttatttgttgaatatacttaacatcttcggcagtcaatattattgcacctatatcggtgaaatcagtttgatttaataaaactaattcacgagttgatgtaaaatatttttgcactaatgggctatgtgcgatttttaattttaacataaaagactcctttgtcttatttaaagaatacaaatcaccctctcacaataaatatagaaatagtgagatagcttacttttaaagttttataaattattaatataaacagtacgtgaatttttatatttatttaactataaaaaacacgaacacttattctagaattaagaacaaacacaggtttttatttatcaagaaaaaccgtataaagaatataaaaattctaggacaaaatattaataaagtagaaaaccgtgaaatcccctttatttaaagggaattaaatggaaaagaattgatatggatcacttttagaatggagaatagcaaaagaaaaacaagaacgatgggacggtttcataaggtgtcgagtacgacgaatatgtgccatcaaagagcgacccttaatagggttatattcttgactataattgtggtctaacataatagcctccgaaatttattttgcttatatagttttagttgactatcgaagcgaattttgcgcctataaaataaaaagtcaataaattttattttttttttttttttttttttttttttgacggagatcacaaaaattaaattttgttactattttatgttatgaattattttccttttttgatccaatatttaaatggagtgttttctaaatcactttttaataaattatgatccataaattgacaaaagctaggaatatctctagttgtggcaggatcatctgcaagaattaataatatttctccttcttgcatatggcgaatttttttgcgtaagagcattattggttccggacaacgtaatccaattgtgtttagagtttgtgttacaataatatcagtcataataatttctttgttagaatagaaagcgtgtatgatagcgtccaatttctttagggtcaaaataagcaaagtatgaaatatcttattccccaaagtgcggttgtttttgaagaagaaattaagaagagccgttttattacttatcttcagcatgcagaaggtttggagcaggctaaagcattttggcattcaataaaaaatcaacatccaaatgctcgtcatcattgttgggcaacggtttcgttacaacccggtaattcgcaaggattagggttttctgacgatggtgaacctagcggtacggcaggaaaacctatgttgaatgttttattggggagtggtattggtgaaatttctgctgtagttgttcgttactatgggggaattttgcttggtacagggggattagtgcgagcttatggaaatggtgtgcaacaagctttgcaattgttacagacaagtttaaaaatagaacgaaaaatttatcaactttattgtgcgtatcatcaggtcaattggttacatgttttatttgaaaaatataatattaggatcatttctcaacattttttacaggatgttcaatttgagttgggtataagtgatgataaactggcagcatttcagaatgacttatctagttattcagcaggacagttaagattattagaaaacaaataagagagaaaattgtgcatattttatctattctgcgtatagtgggaattctagtaacctgcttttccattacaatgttaattccggcttttatagcgttgatttatggagatgggggtggaaaggcttttatcttgtcgtttttttacaatctttcagccggagttgggttatggtggctatgtcgagcacataaggcaagtttacgttcacgtgaaggatttttaatcgtcacaatgttttgggttttgctcagtttattggcagttattccttttatgttgttcgatgagctaacattgagccttgccgatgctgtatttgagtctttttcagccttaactacaacaggggctacagtaattttggggttggatcatttgccaaaatctatccttttctatcgtcaacttttgcaatggattggtggaatgggattgattgtattagtggttgcgattattccattgcttggtattggtagtggtcatttatatcgagcggaatcttcggggccaatgaaagatcaaaaagccttgcctcgtattggtgaagtggcaaaattattatggtttctctattgtatattgactattttctgtgcgtttgcttattgggttgcgggaatgagttggtttgatgcgatttctcatagtttttctacggtgtcaaatggcggaatgtccaattacgacgccagtttaggttactttgacaatccggctatttatttgattagtgctggttttatgctgattagtggttgtaattttgctttgcatattcgagcattaactaattggaaataccaacctgtctggaaaatttacgcaagagatcctgaatttaggtttttctgtgcaattcaagggatatttattttcttattatcgttagggttatatctgacctatgaaaattattctgtttttgatgctttctcacaaggtgcgttgcagtcagtatcaatggcaatgacttcaggttatactttatttgatttaaatcagcttccggcttttttggggatgttactggtctttatggcaatattaggaggatgtgcgggatctactacaggtggtttaaaaatgattagagtgcttgttgtatggttacaaatcaaaagagaatttaaacatttagttcaccctcatttggttattccaattaaattggggaaaatgttattggtacagagagttattgatgggatatggggatttttaattgcatttttcttaacctattgggtatgtgtatttgcggttatattatgtggaatgaatgctgctgatgcgatgttgtctgtctttgccacactaacaaatgttgggccaggtttgggaataattagccaaagtttttcacaagttccggataatgctaaatatgtattttcttttgctatggcagccggtcgtttagaaattttttctcttttacttttgtttacgccgactttttggaaatcataatgaagacattgattttatatttaagccgagagggtcagactaaaaaaatcgcagaatatataggcacaaaatttgaaaaaagtgcggtacaatctttgcttgatttttctggtgatttagctaccttcgatcgtattattattggtgcctcggttcgctatggtcattttgatcaaagactttatcaatttttgcaaaaaaataccgcacttttacagcagaaagagagcagtttttttggtgtgaatttgacagctcgtaaagaaaataagaatacaccggaaacgaatgtttatgttaggaagtttttacaacgtattcggtggaaacccaaatatgtaggggtgtttgccggagcgttgttttatcctcgttattcttggtttgatcggatgatgattagattaataatgaaaataacagggggtgaaaccgatgtaagtaaagaaattgaatatacagattgggaaaaagtagacgattttgtactaaaaattagacaaggtgaatgaaaaatcagcttttgattatatatttgaatttttttgcaaagattgcttgcaaggaagtgataattttctataatacgcctcctcctcttttagaggggaatgagaaatgaatatcatagattatttggaaaaattttaagtaatcacttgacatgaggtttcaatctcactaaaattcgaagccttgcatttttgatgcagtgtaaattgttctttaacaaactatcagacaaactgtgtgggcacttgtgagactgtattaataagagattaaaagagtaagataagtgcttaaactagagaaattcatagagaaaatgtggatgaaatagtcagtatttattgagcgaagagattaaaatgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagggaagaggaaaatgggagaaaaaaagtaataaggtgataacaaggtagtcataaaaagtagggtaatgaagcagagtgaagaggtgcggtaggaaaattgtttttttttctaccgctctttttttaggtgatttatttttagcgatttgcttaatgcagaaaaacgatttgtgagagtttataaaaatgataacgaacaagtatttttacaaatgagcttagaatcaggtatgacagaagcatatttgatagaatctatcaagagattcatatcccttcaaactatgttttctgtgtttgtctcctttgggttgtaggtggtggacctggcggtgttgcattcggattgaaattggcatttggcgattatgtacactgcatttttgctgaaccgactcattcaccttgtatgctaacagcaagttatcgtcatgtgccagatgctgatttgcagggtgaatgggagatgactaaatttgtatttaataaaaaggaatttccgttagagccgaaaagcttgttttatgactggttatatttaaatgtgttgttttctgaacacaatacagcgttgagagaagatttttttcaaacgggttataacgcttttagtgatattgagtttaatcctgagaaatcgtttagttgtcaggcgcgtactttggcattgtgtgtatcgctttatgaaaataatgcgatataggcttttattcaggatcctgtgattttttcagcacaatattcattgtatcaaaaagtaaatcttgcacagcaatcagaacttttttaggagaaatttatgtttttatttcaaaatattgagcatattgagtatgtattcatataaactgatacattcgtcgctaagggtacaattatgtctgaaaatttctcaccactccaatctattgaacctgatctttatcgtttggcaaaagatgctggacatcacctacattcagatccacaatcttcactgatcaaattacgttgttttaccgagcaatttgtactattactctgtaagcagttgcatattgaattagttgataatgaaagcttatcagatcgtatgcgtaaagcagattttaaaacctatgttccaaaagagattcaacaaaaactccatttattgagaatagcaggaaataaggctgtacatacttctttctctcatctagatttttcagaagtggcagactgtttgcgtgaagcctatcttttaggaaaatggctctatcttaatcgcgttcctactacttgttaccctgattttatcctcccaagccctaatcacagcattgaacaattgcaacaacatattctttcattaaaagaagaaaataaaaaacttaatgaacatagccaaaaaataatagcagaaaatgcaaaactacatttatcatttacagaattaggagaaatacgccgagttcaagcggaaaaacttcaagaaaatacagagaaagtaaatttggagagtgacaaaacacttgcacgtttaaaaaaatacagactacgggattgttatagccaatttaaattaaccgatggacaaaaaacattagaggatcaattagatcagtttttagcagatccgaaacaacatatctttttattaaaaggttatgccggtacgggtaaaatctttattacccttggtttaaccgattatttagatcttattgaacgtagctattatttaagtgcacctactggaaaagccgctcgtgttatatccgaaaaaaccagaaaaggtgcatcgaccattcattctgccatatataacttggacaaattagtggaatatcaagatgaaaaagatccgaaaacgtataaattctataccgcattaaaagtaaatacagatatttctgattgtgtttatattatcgatgaaagttcaatggtaagtgatgtttatactgatggtgaatttatgcgttttggttcggggtgtctattaaaagatttaatggaatacattaatatcgatcaaaatgatcataataagaaaattatctttattggtgataatgcacagcttccgccgattggaatgaataattcaccggcgttggatagtaaatatttagctacaaagtaccgcttgaatagtctcgaatatgaattaacagaagtggttcgccaaaaatcggggagtggtattattcaaaatgcggtaaaaattcgagaatgtatcaataaaaaagagtttaatcgtttaaatatggatttaaattatcacgatattcatcaaatcgaggcgaaagacacgattcaaacttatttagagagttgtgggcataagataaatgacgaatcgatgattattgcttgtttaaatgccgatgtgcaaacttataatgaagcaatacgacaatacttttttccggataaatatgaaatttgtcgtggtgataaagtcatgtcattacgtaatcgtaaaattggtggggtgcgtattgccaatggggattttgctttagttagatgggtatcagatgaaacggaaacaaaaacagtgccattgaagaaaaaattagaaaatggcgaagtggagactaaggtaatagaactcaacttccgagatgttgagatcggttttagaaacactgatgggaaagcggtatttgttaaaactaaaattattgaaaatacgctttattccaaagatccacaattaagctcagatgaacataaagcattgtatatagattttagtatgcgaattagaaatgaaagagggattgaatatagaaaaaataaagaggaatttaaaaatgcgattttaagtgatccttattttaatgcactacctcttaaatttggttatgcgattacttgtcataaagcacagggtagcgaatggaataatgtcattgtgcaatgtaataacactcatcaaaatcaacatgctttaggttattctcgttggctttatactgcgattactcgtagttcgaaacaactctatttaattgatccgcctaaatttaatgcatgggataaattaaagaaaactactcctacttctatttcgccaattttactacaaccgcagctagaaaaaacggaagagaggcctaaaatgaaaaatgatcaaacaacagcaccattaaaaccggcattcaatgctgccgaattatcagcaatttctcagctcatttatcaaacagtatctactacaattaataatgcggatattattaacattgaaagcaaacaatatcacgatatttatactgtgttacaagatcaacataaaatccgttttaaagttgcttataatggaaaaaatcaaatcacccatattaactgtattgaaaatttacaagtagttccattattggaaagtcagttaaaaacattagaaggaaaaacattttttattgccgcacaagaaaaaaatgaaattacatttagctatgactttctcaatgaatttcatcagcaagtgatctttaattttctaagtaaaaataagataactatttgctcagtagatgaaaaacagtggaacattcgttatgaatttgccaataaatcggaaggaactgcgactttagatatttattttaatggtaaacatgaatttaccaatatcaaaccaatacagcctaaatcaacgtctaacgagtttttagaaactgtacatcgccttttaatgtcggagttgtgtaaatgttaacttttaccagtaaagaagtttttgcagaaagaaaaaatggcaatgccgagcaagcctataaaatggctaaacagctaatggcaaataatccaaatgacgaatggaatcaaagagctttagcttggtgtttagttgatctgataaaacattctactcaacaacatcaagaggcgatacattatattaatgaatttaagctaattgatgttgtaaaaaaagatgaattgttaacgaagcaattaaattactttgagaaataaaatgatccattgaacaatgaaattaacctcgctagagaagctagcaaatcgcgaaaatataaagaagctgccaatatttattttaagatattaaaacaacaaccggataacttagaaattcaaactagcttcgcgtggagtctttattttcttgctaaagaaacattaagccaatcatatataaaaactgaaaacataaaacgttatttttttgaatacttcaaacttaacattgaaaaaacatcaaaattacatcactgttttttatttcttgcattgaaattggttaagaatgaaaaattagccaaagaaaataatatcgatttttccgatttttgtttaaaatggaatttagataatctgaattgggaagattataaaatacaaaaaatagaaggaaatgaattttctccctttgctttagatatatttagaaatgcattaaaaagtgcaataaatcataataatcatcaaagtttagattatttggttcaatttattgagggtaaaaaaagccagcttcaaggggaaactatttggctggagtgggatttggctaaatcttatcattttttgaatcaggatatattagctaaaaataaagcatttgcattattgaaatcgaaacctaatgaatactggctatgggatttcttaggtgatatttatgctgtgtttgataaagaaacctcggctgcttgttatgctaaatccatcactttacaaaaagatattggttttatctataaaataaaattcaaactggtaaattattttattgcaaacggttattttgaagctgcaaaatgcgaaattaaagaaattattgattataaggaggcatagactcaaaaaactccggaagatattttatcattaacggaaagccaatggtatttatccactgaatgtgctactaataatcaaactttctatcaaaaactttccaaggaggcagaagtcttactttatagcaatcttccttggattgatgcatatttaggagatatttttgaaaataatgataagaaaatgtgtaaagtgtttatcaaatttaatgaaatcccaacggagatttcattacctgaaagcaaactatctttaaaatcagcaaaatcagggaaatatgctcaacttaaaggggaatttgagggaggtaaatttaagctttttctctgccgagagattgatgaaatacatcaacatcaaaaagatttctttactcggaaaatagcaattattgataatatcaatcatgagaaaaaagttgtgcatttcttagtgaatgaaaaaattggtacggtcgtttctataaaagaacttaattttaccccaaaagttgctgatgtagttgagattagcttatctcagcatactctcaaagatggagcaaaacgctacaaggtacatcatattgaaaaaatcgaaaaatcagcacctaatgatttactaaaatgctttgatgaacaaattcgggagaataatggcattgcctttacagaagagagcgatatatttattccaagtgatattgttaaaaattttgagttaagtgatggagattgggtttttggtatcgcaataaaaaattacaataaaaagaaaaaggaatggggatggaaagcggttaaaataacatctaaagagctttaagttgattttgatggagatattttattcatagattagatttttccaagacttatttaatcggcaacaaggtcatatatttatcaatatgaatatcggaaattttttaaatccaataattccactttttatgtcgtgcagagaattatcctaaggcgtagtttttcgtctatgtcttgctcgtgttttgttagctactccaaataaaatgaatgtcaatgggctgattatttgaggtatagatggcaaaaatgatgatactactactgaaagagctagactccccacggaattttagtagctcatcatgccaatgttggtagaccttagaatcaggattcgtcaaagcttgatgccaccctacacgttgtgcaatgaactgtcaaagtcctacatcaagtcagaacaggtaacaaatcgccccaactctaatggaacggctccacatggtacttctaaatagactttgatatgattcaacgcataatccaaaaaatcaaattcgggtaatttaaataaagttgccatatactgattcaacagcggttttcgttgaaatagagttgattttgataatattacttacttcataccccgacaaaaagtcggggtattacgttttaaatcagcaaagttgctgcttttatgacagcttcaatagctttctgttcagtttgatgaatggtttgttcgtttggaatttcttgttgagtacggtttacgattacacctgataccatacctgcacgcagtcccaaagctgaacacattgtaaataatgttgcactttccatttcatagttcatgacattcaatgcttgccattgttttaatgaaccttgataatggcgacaaacttttccgctataggtatcgtaacgttcttgtcctggatagaaggtgtctgatgaggcggtaatgccgatatgaacactatctccaggttcatttgaaacagcatgatgtaaagcggacatgcaatcaaaatgggcaacagcaggatattctagtggagcaaaatgacggcttgcaccatcaagacgtactgctcctgtggtaataagaatatctcctacgttgatgtgcggttgaattgcacccgttgtaccgattctgaggaaagttcggattcccagttgtgctaattcttctaccgcaatagaaacggaaggaccaccaattccagttgagcaaacaacgacggctttttgatctatataacccaaccaagaagtaaattctcgagttgaagctaaaaatttcggattatccaatagacgagcaatacgttctaccctttcaggtgcacctggtacgatggctaactctgctccatccagtgaggcttttgttaagccaagatgaaagacatcagacataaaatattccttttgtttattgtaatatctctcagtataaagcacctctgcaatttcatcaattctttcctgttggtataaaatatgggaaggtacaatatgagtgttaaggttggactctaatcttctataagattagaatattccttgaaatataattccacctgttggtagaaaaattgattttttcactgctctttttattagtatttatttttaaaatatcggtaaatgagtatatcatagagtatgtttttatatatttttcatattattttggactatggatataaaattacatttaaatgcaactacgacaccaaaaattcgagcttatttacaaaaatcagataaatcagatcttgaattagcagaacagttgggtatttcggttcaaacggtacgtcgttggagaaataggcaagatgttaatgatcgttctcatagaccgaaaaaaattaatagaactctttcttttgaacaggaatatttgatttgctatctacgaaaatatttcgctttatctttagatgaacttcttgaagctggaagaaatctaatcaatcaaagagtatctcgagcagttattagtcgttgtttaaaaaaatatggtctaaatattgctaataagaaagatttaccatctcaagttggttgtacttttttggcaatgtttcccttgcctaaagagatttctaaagaggaagattatctttttattctaatagagaaattgacaggatatatcagttgtgcttgcttggacagaaaactacagcgtcaacaaagtattatcaattactttaaatctagtttaccttatgaaattaaagaaattgagttagccgaagatattactcatcatgccatagtacaggcttttgccaaaaagactaaagtagttacgtctaccttaattttgcaaagtgcggtgaattttgaacaagattttatacggttagtatcaggttattacactgatagcagattaggatttgatgcacaactattaagatatgaagagtatctgaataagcatcttaaacgaaatcgcttaaaaaaactgtccccttatgattatcttatgaaatatcgccggtaggacagttagtttttttatttttttcgatatagctcaataaattctttgatgatgtccattaacaaaacagcattcattacatgatcttgtgcatgcaccataataatagtgacgggtagtttcccctcaccttcatcctgtccgatgagttctgtttgagcgtgatgtgctgctaacaaagcatcatccgcctgtttaagtaatctatctacttcctcaaactgctgttttttagcatgttgtagtgcttccattaaagcactacgacatattcccgcttgaagaattaaattcatcaattgcatttcaagttgctcactcatttttcctccaataaagatagtgcttgtgctaaaattttttctccatcggtcatgccataactcatcatatcaatacaagcgacaggtttgccgaattctgcaccaatagtttggcattcttgcagcttataggaaatttgaggacctaataggacacagtcaaaatcttgtattaatgaacgaaagctttgcatacccttagcttcaatttcaacgggtaaaccctgtgcttcagctgcttgtttcatacgtttaactactaagctggtggacatgcctaaatcacaaataagtaaaattcttttcattttttctccctattttgaaacattatttttcagaaattgataaagtagatgtaatggtttaccgcttgaatagattccttgatctctaaataaggttgtgccgctaatatctaaatgagcccaagtgcagtcattaacaaaccgactaaggaaatatcctgcggaaacacaaatcgccgcattatttggcggagtgttgcaataatctgcaatatggctttccacttggccgagaaatctatcatcacaaggtagttgccatatcgcctcttgtgtttgtattgcggctaaattaagttgatgtagaatttctgtattatttgtcatcacaccggaaatatcataaccaagtgcttttacaacagctcctgttaaagttgcaacatcaataattactgagggtttttgttcagctgcgaatgataataaatcagctaaaattaaccgcccttctgcgtctgtattaataatttcaatagtttttcctgaataagatcggacaatctctccggggcgcatcgctttttcatttatcatattttctgctacaccgacaataatacgtatgttaataggcaatgaattttctacaacggtttcaagtaagccaattaataaggcagcaccacacatatcatatttcatggttttcataccatcgcctgtttttaaccataatcctcctgtatcaaaagtgatacctttaccaacgaaacaataggtctgattacaatcaggggagccttggtaatcgacttgaattaaaaaagggggatgtaaaccgcttttacctacggcatataaagtgttcaaaccatggttttgtagctcttctgcatctaagcatcgtatggaaagttgagatttatgtgcataactgtttaatttttttgcaatatattcaggcgtcgcaatatcgctaggcagatctgaaatttttctggctgttatcatacccaatactattttgcatagttctaaataattattcgatagttgccgcttttgctccggtgtttccactataacaccaaattcaggcgatgcggcggtctctttaaaacctaaatattttggatggtaagaaaggttgagataactaataatcaattgttcattgatctgccgttctaattttacggtttcttttccccaatgtaataagattctttgtgcatctgagtgtgccattttttccatcaaaaaatgacgtattttccccattaagtgtgggttttcagccacttcttttttagaaaaaggtaagctatataagccggcattcgatatatttctgcctatctcgattttgctttccatgtccagtatagaaagcagaggtttcaagcagggttgttgctgtaaaaaatctcgatcttctttccaaaaaaacaacaaagcgttttttatctctaattgggtttgccaatcataaagcggaaattcaatgttcattttaactctccatgaatgcggtcaagataagcttgtagccaactttctgaggccggttcatattgtgtaattccattttctcgtttagccagataaatgatagggttatattgctctgttgatacgacaaaggaaaaattatcaatattagttgatacaccgaactctccttgcatattcatacatacaaccgacaaatctcctgctgttccgtaacgttctaataatcgtatttctaattcattgattgtcgcatcagcagcttgttgtggtgtcatcccctctttcatttttcgtacaatttcataactggtacagcctttcattaagtcttcccccagacctgtagctgttgccgcacctatatgggaatcagcatagaatcctgaacctgagataggcgaatctccaactcgcccatgacgtttcataaataacccactggtagaggtacccacacaaatattattatttttatcaagtgcaataatgcccactgtatcatgcccggaatatggacttagtccacgacctagagtttcttgatagcgtttttcataaaatgttttaacacggggtgtaagcatgtctttagcaggaaaacctttctttaatgcccatttttcagcgccgtgacctaccaaaaaactattaaaacgttcatgacttaatgcttcggcaacgagaattggattagcgatattacgcaagccggctacagctcccaatgccagagaagttccatccataaaggcagcgtccaattcgacatctccctcttcattgggtaacccgccataaccaacagatttatatagagggtaattttctacttgtgtaaccgcagttaaaattgcatctcttgcacttcctttgtttttaagtaattcaactgcctgacaaagtccttcaaatgccatacgccaagttgcaatcatcccccatcttgaattattcatttatacttgtccttctttcattcgatattgcttatcaataatacggaagaatggtaaataaatcattgcagcaatgaataagttgattacttgtataagtgcgccggaaatatgcccagttacaataaaaccacttaaaacgggcggtaatgtccaagggatataaactccggttgtcgtcgcaacaatatctaaatacattgcaacatactgtactgtagtaataactaaaggtgcaagattgaatgggataagcataattggatttaaaataacgggcagaccaaataagacaggttcgttgatgttaaataccgatgagccggcagctaaacgtgacacttttttagcatgttggctacgggaaaaaataagcattgctaagactaaggcgagagttgaacctgaacctcccataaagatcatatcaaagaattgttcggtaatcacatgaggaggggttaatccattttgcattgctgccaggttttcagcttgattatctaaccagaacggtcgtaagattccattaaccattgaacctgaattgattcctaccgaccataaaatatcgatcatgaatacggtcagtaatgcaccaatataagaagtaccaaaatggcgaattggtgtagccagcacggtatatacaaattcatgaatagtattatattcagttttcgagaataaaatccgaatgcctaatactaaaatcataatcaataaggcaggtatcagagctgagaatgattgttgtactgccggcggtacgccgtcaggcattttgatcacaatatttttgcgaatgagaaaggcgaataattcggtccaaatgattgccccaagcatagcaataaataaaccttttgaacctagccattgcgttgaaataactgaaccgacgttttcaactttaacaaaaggggtcaaaataaggaatgctgagagagataatataccggaggaaagtttatctatatttagacgttcaccgagtctataggcaaccagaaaagcaataaatatagacattgtagaaaaaacagcattaaagggaatttctatgatattatcccaaccctttccaaaggttgcggtcatgaaatctttatagctttgagatggaaatgaactaattaccagtaaaatagaaccaacaatgataaaaggcataaacgaaatataagcatctcgaattgctcctaaatgacgctgttgggctaatttaccggcagtcgccatcaatttattttcaatttgtttaaacaaggacataataacctccagtaagtaagaaattacaaaacttattgtaggtgatttttgtttgaaaaaagttgataaagatcacaaaattaaaaaagtatcatatgattaattttattttaatgtaaatattattagaatatatttaattttttaaatgtttaattatgtgatacattttttgaggtttgtatggatatagaaatatgtattgataatattgagtcagcattaattgcacaaaattcaggtgcggatcgtttagaagtatgtggatgtttagcgttaggaggggtaactcctccttatagcctgatcaaaacagtattggatgtgtgtaacattccctgttatgtaatgattcgtcccagatccggagattttttatttaatgcacatgaaataaaaatgatggagcaggacatccacattgcgaaacagttaggagctcaaggtgttgttattggagcattaaccgaaaacggtgaaattgatttatcaatttgccatcgtctaataagtgcggctgaaggtttgggggttacttttcatcgtgcgtttgatctttgtagcgatccttatcatggtttagaacagcttattgaattggggtgtgagcgagttttaacttcaggacagcaaaggacggcatttgaggggagatatgttttaaagaccttggtacaacaggcaaaaggacgaattaagattatggctggtgccggcgttaatccaaataatgccttggaattggtaaaaatcagtaaagttgatgaattacatttatcagccaaaacttttcgtcagagttcaatgaaaggtaattccagtgtgacgatgggaaataaagcagaagatgattacaaaatttggacaacagatcgaaatcaaattattgccataaagaaacttttccaagaatagaggggcataaattttatctggagagcggtgaaaaaaacaaaattttcaccgctcttttttcattattcaaccaactaattttgccgtgaaaatattactaataaccacaacatttttagagaaataaggtagaatacgcccctatttatttttataaagagctttgttttatttatgttatttgcaattggtcagcgttggataagtgaaagtgagaatagtcttggtttgggtattattacgggacaagataatcgtaccgttaccatttcttttcccgcctcggatgaaatacgtatttatgctttagcaagtgcccctttaactcgagtattgtttcaaaaaggtgatgagattacacaccaattaggttggaaagcaaaagttgttgatgtcatgattcgcaatgagttggctttttatcttgtgcaacgacttgataataacgaagagattgctgtacaagaaatggaattagctcaccaaatttcttttagtaaaccgcaggatcgcttatttagtacacaaattgaccgcaatgagcattttgtattgcgttacaaggcactaaaacaccaacaagaacaatttcagtcctctttaagaggattaagaggaaatcgagccggtctgattcctcatcaattacatattgcacaagaggtagggcgacgtatcgcaccgagggtattattagccgatgaagtcggtttggggaaaacgattgaagcgggtatgattttacagcaacaattgcttgctgaaaaagttcagcgagtgctaattttggtgcctgaaactttacagcatcagtggcttgttgaaatgctacgtcgttttaatttgcatttctctttatttgatgaagaacggtgtgctgattttgataatccggaagatcatgttgaagcaaatccttttgttgctgaaaacctaattatttgtgctttagattggcttgttcaacaaccgaaacgtgcaaaacaagccttggcgggtgagtttgatttattgattgttgatgaggctcatcatctcacttggtcggaagattcgccaagcatagcttatgaattggttatgcaattaagtgcggtgattcctgccgtattattattaacggcgacaccggagcaattggggcaacaaagtcattttgcccgtttgcatttattggatcctaatcgtttttatagttatcgggcttttgaaaaagaacagcaacaatatcaacctgttgctaaagcagtacaaagtctgttatcagagcatattttaacagttgaagaacaaaatcatttagcagaattacttagcgagcaagatatcgagccaatgctcaaagtgattaattctcaagctgatacggaacaaaagcaggttgctcgaggagaattaatgagtaatctaattgatcgtcatggaaccggtcgcttgttatttcgcaatacaagacaaggtgtgcaagggtttcctcatcgtatttatcatcaaatcaaattagatttaccaacacaatatcaaaatgcgattaatgtgttgaagatgttgggggaaataaaagatcctgagttattttatcctgagcaaattttccaaaaaatgaatgcggatgcaacttggtggcgttttgatcctagagtggattggttaattcatttagttaagagtttacgtgaagaaaaaatcttagtgatttgtcaagatgcgataacagccacacaattggagcaggcattgcgagagaaggaaggaattcgtagtgcggtatttcatgagaatatgtcgattattgaacgagatcgtgcctctgcatattttgcacagcaagaagagggtgcacaggtattactaagttcttcaatcggttcggaaggtcgaaattttcagtttgcttgtcatttagtgttattccatttgccgaataatcccgatttattggaacaatgtattgggcggttggatcgtataggtcaacgtcgagatattcaaatttatgtcccttgttttgctgatacaccgcaaattcgcttggctcaatggtaccatgaaggtttgaatgcatttgaggaaacctgtccaatgggggctattttgcatgaaaagtgcggtgcaaaattgacagaatttttaacttcagacacaacggacgattttcagtcttttattcaacagactcatcagcaacaattacagctaaaatccgaattggagcaaggtcgagatcgtttattggaacttaattccaatggcggtatccaagcccaacaattagcaaatgacatcgcgatacaagacggttcaacagagctcattgatttcacattgaacttattcgatattattggtgttgagcaagaagatcttggcgaaaaatctattgtcattagcccgacaggaacgatgcttgtccctgattttccgggtttaaaagaagaaggggttactgttacttttgatcgtgatttagcattggctcgtgaagaacttgagtttcttacttgggatcacccaattgtgcgtaatgggattgatttaatcgtcagtggtgatataggtaaaagtgcggtggctttattggtaaataaacaattaccgaccggtacattgctacttgaattagtttatataattgagagccaatcaccacgtggattacagttgactcgctttttacctccaacaccgctacgtttacttcttgatattaaagggaatgatttaagtcatcaaatttcttttcagggcttgcaaaaacaactgaaaccaatgggtaaaaatatggcaacaaaagtcattaaaataatgcgtccagcgattgagcaattaattaagcaaagtgaaaaaaatgtagttgagccggctaaaatgataattgaacaagctaaacaactggcggatcaatcattgagtgcggaaataaatcgattatatgcgttgcaggcggtcaataaaaatattcgtccggaggaaattgaacagttagaaagtcagcgtacgttatctcttgaattgcttaatcaagcaaattggcgtttagacagtttacgggtaattgtgagtaataaggaataacatggcattaattgattatcgtccccctttagaaccttatttggacattgtatatcgtgatgatcatattcttgtggtgaataaaccgagcggcttgctttctgtatccggtaatcaaccgcaatattatgatagtgcaatgtcgagggtaaaagaaaaatatgggttttgtgagccagcacatcgtctagatatggcaacaagcggcgttttgctttttgcaatgagtaaaatggcagatcgagagctaaaacgccaatttcgtgagcgtgaacctaaaaaacattatcaagcactgatttggggacatttagcacaagataccggctcagtgaatttgccgttgatttgtgattgggagaatcgcccaagacaaaaagtgtgttttgttcatggcaaaagagcggtaacaaattttaaagttttgcatcggtttgaaaataatatcactcaagtcagattaacgcctattaccggaagatcccatcaactgcgtttacatatgcttgcattaggacacccaattttaggggataaattctatgcacatccacaggcaaaatcgcttgcaccacgtttgtgcttacatgcagaatttttacaaataactcatccgcttacaaagaaagtgattcagtttagaacaccggcggattttccgatgtaagttgatcgcacaaaaaatcaccccttaatccatatgattgaggggtgtgtgttcataagaagttattgtctatttttataatattcaatagcttgtggcattaattttaatagattcgcttggcgaacatcatcggtggggtgagttgagatgagcttatccagcaaaccttttgaacccccggaggcttttttcattttttcccacaattgtggtgctgctttaggattgtagcctgattttgccatcaggaataagcctacttcatccgcctcttcttcggcactacgtgaataaggtttatttaagccccaatccgcagcaagtccgacaatcagtccacttgcgtcagtgccaatttttgttgataaagcaacatgagcaacctgtgcaaccacattagtgaacgtacccaaattcgcttttttcttaccatgttcttttaacgcatgtgccatttcatgccccattactgtagcaatttcatcatcagttaattttaagttgtcaactaatcccgtataaaacaccattttgccttccggcatcgcccaagcattcatttcttttgatttgataacatttaattgccatgtaaaaacttgcccggtgttgttttctttatctgcataaggatgcatttttttaaaaattttatgtatacgttttgccgtcggtgagcttttatcaaccactccttttgcttcagcttgcccgattatctgcacataacttgaggcagactgttgattaattgaagatgaatctgcacaagcattgagcagtaacacagtaaatatgacaaaaataatttttttaatcgacataatgatatttaaactgttaataaaaaaccgccctttgagtaagagcggtttttagagattattttttagcacgttcgaatgattctaaaatttcttggcgagctgcttcaacgccttcccaaccttctactttaacccatttacctgcttccaatgctttatagctttcaaagaagtgctggatttgtgcttttaataaagccggtagatcatcaacatctttaatataatcatattctttacttaattttgtgtgcggaacagctacaactttcgcatcgcctcccgcctcatctgtcatttttaatacaccaactggacgacaacggattacagaacccggttgtaacggatatggcgttggtactaatacatccacaggatcaccatcagaagaaagtgtattatttacataaccatagttcgccggatagaacatagcggtcgccataaaacgatcgacaaataatgccccactttctttatctacttcgtacttgattggatctgagtttgccggaatttcaatgacaacataaatatcatccggtaacgctttaccggcaggtacattttctaaacccatttttcttttccttttacatgttattgatgaatcaggttggggaattatagcgttatttctagggaattgtcgagttatcaacaaagaatcttcttactgaaaaaagtattgtaaaaaagttttgaactattataatagttcaaaatttaattttcaaaatgaggatctattatgacaaaaaaaatcccttctttatttggtggtgcaatgattattgccggaggaactatcggggcaggaatgttagccaatcctacttcaactgcgggtgtatggtttttaggttcaacattaatcttaatttatacttggttttgtatgacaacatcaggattgatgttacttgaggcaaatctacattatcctacgggtgccagttttgatactattgtcaaagatttattagggaaaggttggaatttgattaatggtgtgtctgtcgcatttgtgctttatattttaacctatgcttatatcacttcaggcggtgggattacgcaaggtttttttaatcaattgttaagtagtacagaaaatgcggtagatattgggcgtagttccggatcgcttatcttttgtattgtgctggcagggtttgtatggttttccacgaaagctgttgatcgtttcagtgtggtattaattgcaggaatggtcatttcctttttcctctctataaccaatcttgtcggttcggtaaatacagaagtattgctaaatgctgtacaaggtgaacaacaatatttgccttatgcgttggtggcgttacctgtttgtttggtttcttttggctttcatcaaaatgttcccagtttggtgaaatattatgatcgcaatgcaagtcaggttttaaaagcgattttcataggcacaggcattgcattagtgatttatatcttgtggcagttggctattcagggaaatttaccaagagctgaatttataccagtcattgaaaagggcggtgatatttcagcattattagacgcattaagtaaatacttacaaacggattatatagcacttacactgaaattttttgcttatatggcaattgcaagttcattcttaggtgtaacgttagggttatttgattatatcgctgatttatttaaatttgatgatagtgttgctggacgcactaaaacagcgttaattacgtttttaccgccattattattgagcttacaatttccttacggctttgtattagccattggttatgctggtttagcggcaacaatctgggcggtaattgtaccggctttattagcgaaagccagtcgtaagaaattcaaaagtagcagttttaccgcttacggtggaaattttatgatatatttcgtcatcgcatttggtttattaaatatcctcgcacaacttgcaatgcagttcggttttttaccggagtttagaggctaaatagcttgaaaaagtaagaaaaataattatcttgttaacgtatgctttatttggcacccactgtggatacgtgggtgcttttctgtaaattttcctagtattagctttgatttgtttgctatagtaggcacaatttttagggagtattgtaggacaaaaatggcagaaaaaatcattattgctgaacatcagtttatgcgtacgatttctcgtatttcccatgagattatcgaaaaacatcagtcgcttgatgatattgtgattgttggcattaaacgtcgaggtgctgaacttgccgagttaataaagcgaaaaattatagagttcagtggaattgaattgccctctattgatttagatatcacttcttaccgtgatgatttagagtatgtggatcaacagcaccagttgcctgtttatagtggagcatccaattatattaatatccaaaataaaacggtgattttagttgatgatgtgttgtttactggtcgtaccattcgagccgcacttgatgctttagttgattttggtcgagcggctaaagtggaattagtgatttttgtcgatcgtgggcatagagaattaccaattcgtgccgattacgtcgggaaaaatattcccacaagtcgtagtgagcaagttcaggttcgcacaatgcaatttgatgatcgttatgaagttgccttggtcacaaaataacatttgtgaaccttttgcaaaattgctactctaatgaacaaatttacaaacgtcttacggaatgaaaaagcggaataaaaaaatgaaagtatttaatttcaaagcagtgttgttttcaataattggtctacttagcattacgataacagcacaggcggctgaaagggtagtggctaccgttgatgggaatcctattttagaaagccaagtaaaaaaggtgttgggaaaacgagcaaataatgaggaaaatcgtcaaatagctttgaatagtattattgatgatttactagtacaaaaagctattcaagagttaggaatcaaggttgctccagcacatgtagatagtgttatcgaaaatattgccgcacaaaatggattaacctttggacagtttcttgatgttttagattatcagggcattaattatcaggcgtatcgtcaacagattgcctatcagattttaatatctgaagtgcgtaatcaagctattggcagtagcgtgaatgttactcgtgaagaaattcaagacttaggactaaaactatttaaacaagcgaaaaaacaaggaaaagagaaaaaagtaaccgcacctgaatataatgtacggcatattttgttaaaattgaatcctctgctgaatgatgcacaagccaaagcaaaattaactcaaattcgtgcagatattttggcgaataagataacctttgcggatgccgccttgaaatattctaaagattatctttccggtgcagatggtggaagtttaggttttatgttccctgaagcttatgttccagagtttgccaaggttatccgaacatctaaaaaaggtgtgatttcgacaccattcaaaacagagtttggttggcatattttagaagtaacggatattcgcaatgcggatataacgagagaagcttatatgcaagaagcatatcaacaaattgtgaatcaacaattgcaagaggcatcaggcgactggataaaggctttgcgtaaacgagcacatattcaatattttaattaattatgagatcccgacgcaaagtcgggatttttgttttataataccgccaattttttagcattcacactttcacttatgaagtcaaaaacacatttaggacatactgctcgtaaacgttttgggcaaaatttcttgcatgacaataatattattcaaaatattgtgatggcaatttatccacaaaaagaacaatttcttgttgagattggtcccggtttaggtgcgttgactgaaccggttgccgaaaaagtagagcgtttaacggttattgagttggatcgtgatcttgctgaacgtttacgccatcatccatttttacatcaaaaattaaatgtgattgaatatgatgcaatgcaatttaattttgaacagctttatattgatgaaaacttggctgagaaaaatcagaagttacgtgtatttggtaacttaccttacaatatttcaacacctttgatgtttcatcttttcaaatatcatgcaattattcaagatatgcactttatgttgcaaaaagaggtcgttaaacgtctttgtgcagcaccaaacagtaaagcttatggtcgtttaactatcatggcacaatatttttgccaagtattaccggttttagaagttcctccgaccgcatttaaacctgcacctaaagttgaatcggctgttgtgcgtttaataccacataaagaattaccttatccggtgaaagatttgtactggttaaatcgtgtgactacacaagcctttaaccagcgtcgtaaaactttacgtaatgctttatcaaccttattttcggcggaaaaattaaccgcacttgcaattgatttagaggcacgagccgaaaatttatctattgctgattatgcaagattggcaaattatttagcggataatccgccaacagaagatctgcaatcggagtaaaaatccaagacaaaactgcaagagttaagataataatcaatgacaacattatggcaacttatttagtcggtgatttacaaggctgttatgacgaattacagcttttgttagagacggttcaatttaatcctgtacaagataaactttatcttgttggtgacttagtagcacgaggcgataaatccttagaatgtttgcgttttgtaaaatctttaggggcggcggcacaaatggtattgggcaatcacgatttgcatctgatttcaaccgcacttggtattaaaaaagtaagtttacaagaccatgtcgaagcgatttttacagcaccggattttgttgaattaattgattggttgcgacatcagcctttgcttgtccatgatgaaaaatgtgattttgtcatgagtcatgcgggcatttcgcctgactgggatttggataccgcaaaatcttgtgcaagagaagttgaaaatgaattacaacatggtgattaccattatttaatcagcaatatgtatgataaccaacctgatcgttggtctgccgatctgcaaggtttgcaacgtttacgttatagtatcaatgtatttactcgaatgcgtttttgctacagggatcatcgcttagatttcgcttgtaaagcgtcagtagaaaaagcaccgcaagaacttatcccttggtttaacttggataatccgttgtttaaagtacaaaatttggttttcggacattgggcaagtttagtggatacaccgacaccggcaaatatttatgcccttgatacaggttgtgtttggggtaaccgtatgacgatgttacggtgggaagataaacagtattttgttcaaggagcattgaaagattatttttagagtggcaacagtgcaatattatgtcgtgtgcaataatctgaataacagagaactgtagtgcggtgcggttcatataacaatatatgttaagtgtgcggttgtattgtgagtaacgatttttccttgtcgccgctcaagaatttccctgttcatttctctggttttaggctatcctatagcacattttctatatccaatttgcaccgcactttccattatgaataagtcttttagtaaggggtttagcggaaaaagtgcggtaatttttcatataaaaggtaatattatgcaagaacaatatcgtcctgatcttatcgaagcagacgtacagaaatattgggctgaaaagaaaacattcaaagccgttaaagatcctttcaaagaaaaatattattgtctttccatgtttccttatccttccggtcgtttacacatggggcatgttcgtaactataccattggcgatgttatctcccgttatcaacgaatgaacggtaaaaatgttttacagcctatgggctgggatgcttttgggttgccagcagaaggtgcggcaattaaaaataaaaccgcaccggcaaaatggacttatgaaaatatcgaatacatgaaaaatcagcttaaagtgttgggcttcggatttgattgggatcgtgaaattaccacttgtaaacctgaatattataaatgggagcaatggttttttactgagttgtacaaaaaaggattggtttataaaaaaacctcaacagtaaactggtgtccgaatgatgaaaccgttttagcaaatgagcaagtacatgaggggggttgttggcgttgcgatacccctgtggagcaaaaagaaattccgcaatggtttattaaaattacggactatgctgaacaattattaagtgatttagatcagcttcctgaatggccggatatggtaaaaactatgcaacgtaactggataggtcgctccgaaggggttgaaattacctttaacgttgctcattcagatcaaaccttaacagtttatacaactcgtccggatactttctatggtgtttcttatttagcggttgcagcggcacatccgttagctgaaaatgcggcaaaaaataatcctgaattggctgcttttattcacgaggcaaaaaataccaaagtggctgaagcggaacttgctacaatggagaaaaaaggcatggcaacaggattgtatgcagttcatccgatgacaggtaaacagttaccgatttgggtagcaaattttgtgttaatgcactacggtacaggtgcggttatggcagttcctgcacatgatcaacgtgattatgaatttgcacaaaaatatcaattgcctttattccccgtgattaagccggcggataattctgcatgggatttttcaaaacaggcttatactgagcatggtatcaccattaattctgctgagtttgacggtttggattttgaggcaacctttaacggtattgcggataaacttgaaaaaatcggtgtaggaaaacgccaagtaaactatcgtttacgtgactggggagtttcccgtcaacgttattggggagcaccaattccaatgctgacactggaaaatggtgatgttgtagttgccccattacaggacttaccaattgttttgccggaagatgtagtcatggacggagtaaaaagtccgattaaggctgatcctgaatgggcaaaaaccacttataacggacaagtagcattaaaagaaacggatacctttgatactttcatggaatcttcttggtactatgcacgctatacctctccacaatatcaacaagcgatgttagatgcagatgaaacgaattattggctaccggtggatcaatatattggtggcattgaacatgcaaccatgcacctattatatttccgtttctttcacaaattgttgcgagatgccggtttcgtaacttctgatgagccaagcaaaaaattactgtgtcaaggtatggtacttgcagacgcattttattacaccagcccaaccaatgagcgtatttgggtatcgccgacaaaagtaacgttagagcgtgatgagaaaggtcgtattatcaaagctgttgatgatgaaggtcacgagcttgttcacagcggtatgaccaaaatgtctaagtccaaaaataatggtattgatccgcaagaaatggtggagaaatacggtgcagatacagtccgtttatttatgatgtttgcttcaccggcagaaatgacacttgaatggcaagagtcaggagtagagggggcaaatcgtttcttacgccgcctatggaatttagtttttgaatacaatcaaaatccggcacaaaccgcattagatcctaccgctctttcagtcgaacaaaaagcattgcgtcgtgaggtacataaaactattgcaaaagtgagcgatgatattggtcgtcgccaaacattcaataccgcaattgcggcaatcatggaattaatgaataaactcaccaaagcatcattatccaatgagcaagatcgtgcagtaatggcggaagcattgaatgccgttgtgcgtatgctttatccgattacaccacatatttgtttccaactttggcaagacttaggtaacgaaagtgcgattgattttgcaccttgggtgatagccgatgctgaagctatggttgaagatgaaaaattggttgtgatacaagtgaatggtaaagttcgtgctaaagtaaccgttcctgctgatatgtcggaagatgaaattaaacaagttgctttagcagaagaaaatgtacaaaaattcttgaatggtttaactgtagttaagaccatttatgtaccgggtaaattatttagctttgtagcaaaataagaaaacataaccgcacgtgaaagtgcggttcaatttaggggaggttttatgttcaaaaaaattaaaatagcattactgggcattggcattttgcttattagtgcttgtgggtttcattttcaaaatggtgaattaattccatatgaattaagaacattggtactggaaagcaacgaccctcacagtaaaatgtcaattgcactacgtcgtcaattacaagctaacaatgtgagtatcgttgataatcaaaataatgtcactgttttgcgtctaaatagcacaaaaaatactgagcaggtagcctcagttttcaagcgaggttatgaagcagagaaaattttaaccttagaagtatgggcaacagtgagtttaccgaataaacaaagctatccgatttttgctaatgtcaaccgcactttctttgataactctcgtgccgcattagcaaaatcagcagagaaggagattatttggaatgatatgcgtgaacaggcagcccgccaattaattggcaaaatgattgcattacaaacgcaacttcaaggtaaataatgaaccgcatcttttccgaacagctccaattatcactcaataaacggttgtccactgtgtattatttggttggacaagatcctttattgctgactgagagccgagatgcaattgtacagactgcgatattacaagggtttgatgaaaagttagaaattactgtagataataccactaactggcgttctattttggaacaggctcaatctatcgggttattctttaagcgtcaaatgctgattttaactttacctgaaaatccgaccgcacttatacagcggaatttacaagaactgataacgtcgcttcataccgatatcttactgattttacagatggcgaaacttactaagccaatggaaaaacaaacgtggtttgaattagcaggacaaaaagagcctcaagctgtgttagtgaattgccaaacaccgactgtcgaccaattgcctcgttggatcagtcagcgtgcatacagtatgaaattagagattgtgccggaggcgataaatctgctttgttatagctatgagaacaatttacttgctttaaagcaggttttacaattgcttgatttgctttatccggatcataaattgacctttaatcgagtgaattcggtcatagagcaatcttccgtatttaccgtatttcaatggattgatacgttgttagagggaaaattagagcgggcagtgcgaattttacaagggttaaaagcagaagatgtacaaccgataattttgttacgtgctttacaacgagagctactcacgattttacaattgacccaaccacaacagcatatcgctaatattgacattccgctggtgagttcacaattaaaagaacggtttgatcgcttaaaagtatggcaaaatcgacgtcctttttttatccaagcgatacaacgtatgacttaccgaaagttgtatatgataattcagcaacttgctgatttagaaagaaaaaccaaggcggattttagtcatgatatttggaatgaattagataatttatctgcaaaaatttgctgtttttagttgaattcacaaaaaatttaggtttattccatatctctactaacgctttttcttggattcatcattttttgtacaaaatatccgttataattcgtcaattaaaaaagttaatacataggaagaaaaatgatacgttttgaaaatgtgagtaaagcctatttgggcggtaatcctgctttgcaaggactcaattttcatttacctatagggagcatgacttacgttgtggggcattccggtgcagggaaaagtaccctattaaagttaattatgggcatggaacgagcaaatggcggtaaaatttggttcaatgggcataatattacacgtttatctaaatatgaaattccttttctacgccgtcaaattggcatggttcatcaggattatcgtttaatcacggagtataccattgctgaaaatgttgcacttcctttaattattagtggtattcatcctaaagaggctgaaactcgagcattggctgctttagatcgtgttggtttgcgtgagcgtgcgaaacattaccctgtttatttatcgggtggtgaacagcaacgagtggatattgctcgtgctattgtgcataaacctcaattattattagccgatgaaccgacgggaaatttagatatcaaattatcgttgggtatttttaatttatttgaagaacttaatcaattaggcatgacggtgttaattgctactcatgatttaacacttgtccagcagaaaccgaagccttgtttggttttggaaaatggttatttacgttaaggaaaggttatggcttatcgtcctatttatgcctcttggggcgtgcaggtacattatgtactgaaagcagtgttggcagggttaatcaagaaaaagtattcaactttaatgactattttagttattgcggtttcgttaaccattccaaccgttagctatttgttgtggaaaaatttatatcatgcaacgacaaaattttctcctaaaactgaattcacgctatttttgcataaaaatctatcggaaacagatgccaatattgttgtagagaaaatacgtcagcaagagggcgtagaaagtttaaattatatttctcgaaaggaaagtttaaacgaatttcgtcatttttccggcttttctgaaggattggatattctggatgataacccgcttcctgctgttgtaatgattaaacttactcaagaatacaatgaaaatactaaacgccatcaactgcgtgaaaatctttttaagattaagggagtggatgatatacgtttagataatgaatggttagaaaaattgaccgcactttcttggctaatcgcacatattgcgatattttgtgccgtattgatggtatgttcagtatttttagtaattggaaatagtatccgatctgatgtatatagcagccaagcgaatattgaaattatgaaattactaggtgcaacagatcagtttattttacgtccttatctttacaccggcatgatttatgcaatattaggtgcgttatttgccggtatatttagtgccgcactcattggttattttacaagtgcggtcaaatatgtcactgatatttttgcagtcagttttacgttgcaaggaattactatcattgagttattgtttttatttgtttgctgtacattaatgggctatttaagtgcttggctctcagcaagtcgttatatgaatttgttacataaaaatattagataaaaagcagaaaatttaaaattcttcgcttttttattaaaaaaacttgattttatcttaaatgttctgtaattaattgagatattctttttacaattcaacacaacattaactaataagggagattatatgaaaaatgtaggttttatcggttggcgtggtatggttggttctgtactcatggatcgcatggtacaagaaaatgactttacgaatattaatccagtattttttaccacttctcaggtaggacaaaaagcccctgtttttgcgggtaaagatgcaggtgaattaaaaaatgcgtttgatattgcagagttacaaaaactcgacattatcgttacttgtcaaggcggtgattataccaatgaagtttatccgaaattaaaagcaacaggttggaatggctattgggttgatgcagcatcggcattacgcatgaaagatgatgcgattattgtattagatccggtaaaccaacatgtgattagtgaaggcttacagaaagggatcaaaacctttgttggaggaaattgtactgttagcttaatgttgatggcaattggggggctgtttgaacgtgatttagtggaatgggtttctgttgcaacttatcaggctgcttccggagcaggtgcaaagaatatgcacgagttattagtacaaatgggacagctggaagatagtgtcaaggacgaattggcaaatcctgccacatcaattcttgatattgaacgtaaagttaccgccaaaatgcgtgcagaggacttctcaacaaccaattttggtgcagcattagcaggtagcttaattccttggattgataaattattaccggaaacaggacaaactaaagaagaatggaaaggctatgcagaaaccaacaaaatcttaggactaagtaataatccaattccagttgacggtttatgtgtacgtatcggtgcattacgttgccacagtcaagctttcacgatcaaactgaaaaaagatttacctttagatgaaattgaacagattattgcaagtcacaatgaatgggtaaaagttatccctaacgataaagaagtaaccttgcgtgaattaacgccggcgaaagtaacaggcacattaagtattcctgtaggacgattacgcaaattagcaatgggacctgaatacttagcggcatttacagttggagatcaattattatggggggcagctgaaccggttcgccgtattttgaaacagctagtgctttaaatttaagagtgtagttaaatttattactcaagttgacactcgttattgtttgttatctgaattaaatacagtgataataaaataaataaagccctaattggggcttttttatattttaattattaatttgaacgcacttacatcaatgctttggtaggattttttcgctagaaataaaaaactattttttcatcaacaaatcacaactttttcttcatcagcattcgcatgttcgattttaccgattacccatgctttttcgcctacttgttgtaataatgccaatgcagtttccacatcttcctgtgggagagcgataatcatgcctacgccacagttaaaggttctatacatttcatagcgatcaatatttccttgttcttgtaaccatttgaaaataggatgccattcccaactcttttcattaattaccgctttaacggaagacggtaaaacacgcggaatattttcccaaaaaccgccgcctgttaaatggcaaatagcatgaacgtcagtatgtttaattaattgcaacaccggttttacataaatttttgtcggtgcaagaacttgttcagcgaatgaatgctcggctaattgtgctgttgtcggatcaatacctgaaacttcaatgactttgcgaattaatgaatatccatttgaatgaggaccgcttgaagctaaggcaagtaatgcatcgcctgctttaacgttggaaccgtcaataatttccgatttctcaactacacccacacaaaaacctgccaaatcataatcaccggtatgatacattcccggcatttctgcggtttcaccccctactaaagcacaaccggcttgcacacaaccatcagcaatacctttgatgacatctgctgcaacgtccacatccaatttacctgttgcataatagtcgagaaaaaataacggttctgcaccttgcactacaagatcattgacacacattgcgaccaaatcaacaccaattgtgtcatgtttttttaggtcaatcgcaaggcgtaacttagtcccaacaccatcagttccggatacaagaataggatccttatatttacttggcaatgcacatagtgcaccgaagccccctaacccaccaataacctcgggtctagttgtacgttttacatcagatttaatacgttctactaatgtattccccgcattaatatccacacctgcgtctttataacttaatgattgtttactcacaattgaatcctaaaattagtatcgttattaaaataagcgatattgtaacacgctcaggcaatcgttttcgatgaattttgtaaagaaattttatcttttattcagcaaaagcgggttgaaaaataaccgcacttttcctcgtctaaaaacgcagaaatgattatctaacgaattttcctgaaaatgatttaatccattagaaaatcatgcaaaatttcggcggtaaattctttccgcaaataaaatcctaaaggcaaagtatcgattatttcgccatttttaccgattcctttggttaacgctcgactatttgcccctttgggacggagttgcaggacctcaccaatacgggctgtaatttctgtgagcttacccagcacaatataatccatcaattcttcccaatcttgacgcagacgttgttcttgagaacttgatggctgccacaaaattggtacaccgacatggcgttcagcaagcggaatttgacgttcaccctcaataggaatccaaagcactttggataatttatatctgacatgagaagagtgccacgttacaccgctattttgggctaaaggtgctaaactcacaaaagtagtttctagaggataaccttgttgattaacaggaattgtttttagctcaatacctaaatggctaaaatcttgttccgctttgcttccggcagttgcacccagtgcggtttcaataagcattccgacccagcctttatctcgcttcaaatcaggaggcacaaccaaatttaactcttctgctaattcagcaaaggttaaacctgcaatagattttgcacgttgtaacagttcagcttcgtgttgagggggagtaagtgcggtcatgattgatgatatttttgtaataactttggtttcacgtattcaatgcctcgatcaatataatcaattttttccaattgcaataaatagcgttttgccggcaagcctccgccaaaaccggtaagttgcttttgttttcctaaaatacgatggcaaggaataataatgctaattggattacgtcctacggcaccgcccactgctcttacggctttcggatgatcaatgaaacctgccaattcgctgtaactggcggactgcccatatggaattcggcgtaaagcctgccatattttttgttgaaattttgtgccttgcggatgtaaagaaagatcggaaaaatcttccgcttcccctttaaaataacgatccaatgccgatgttacctgcaaaaagagcggtagattttgattaaaaatccaacgtgaatttggctcaatttgttctaattcaaaatcaagatttgtcagctgattattttgcgacaacatcagcaatcgtccaattggcgaatgataataacaataaaaagtaggttgcataaaagaaaaaaggcgtattaacaaaatacgcctgattataacgaatagccgttagaaacggtagctaagatttaaaccgtacaaattggcacgtgccgttgattggtagtccgcacttactacggctaactgtacatttgtaacctgacctctattacccggataagatacagtatttccaatttcatatccctctttaaattgccgttttttaccacgtaaatgagcaaaacctacgtcaaccgaaagatttggcgtgaaatgataggttgcccccaagctataccaagtgcggtcggtatcggggattgaagcactcggatgttcggcggattcatcataagcaatacccgcacgcaaggttaatttatcattgacattataagtcgcccctagagctacacgagaactgtcatcaaagttttcatctttatgaaaagcgacctgaccgttatcataaacggcatgcaaactttgtaaacggctccatttagtatatttatagctatagtgcatagcgaatttttccgttaattggtggaaaccggaaatttcaagatagtccggtaaatgtaacgttaatttacctctatttctataaggttcaatacttccagatccagcaagtctataacgtaatgcatcgctatctttaaaattaatatctaccttggaatgataggcaataccgatacggttaccctgattaaattcataaactgcaccgatattccaacccaatccccatgcattgttatcttgtaattgcactataggggaatttgcatcaaccatagaggctagtggtgagaaaatctttttcagtttaggaagagaagcaagtttattaactcccttatctaaaataccggcacgacgctcaattttcgctttggcataaaccgcatttaatcccacaccaatgcttaagcctttgctgatacgatatgaaccgcttaaatttaaattaatggaatttagctcggtagttccgccaaaaacaccggcttcgtaattgcttttatattggctttttaatccaaagttcacattcatcgccgcaccgacagcaaatttatcattaatgggtgcaacaaaatacatattaggaatcaaagcaccgggaacaatattcttttgtgtggcttcttcggttattggttgtccgcttgctccctgaccttgtaaagcttttccggcagaaacactcacattaccattcagattaatcttagactgcacataaacccccccccatggagaattgttttgtattaaataaactcattaacgcagggttggtcgccacaacagcagcattatcggcaattgccgcttcccccgcataagcacgtcccaaaccagaactggaaacttcagcaagttggaatgccgccgcattggcataagttgtggataatgctagtgctgacgcaataagcgttggcgtaaaaaagttttttgtgaatttcatttttttcataagcaatatagataatcttagttgttaaaagtccatcgaattctaaaacatggttatgacatgagcaaataagtttacgccattaggtaagaggtcagatcagttaaagagggtttattttttttaacctgttacattttatgacaaaaagagcggtccaaattggtttggaagttggagcaaaattaaaataatgttaaaattccaccaattttttaattttaaatcaaggaaataacgatgtcagaaaatgtattgaaatgtactccggaggaaactaaggcttgttgttgtgcagatgtgggaacgattatagataattcggaactcagcgtagacttttctcaagtctatgaaaatgaaacaacagctcaagaggcattggcatatttaacggaaaaagccagaaaagcggaaacggaatcttgtgacattcgtagcgagattaaggaagtaaacggcaattatcagcttaatgcaacgtttacttttagctgtcaagcagaaacgctgatttttcaattatctataagatgattgaacaaatgaggaatcgaaaaaggatcatgttgcccgtagcacgagttaaggcaatatgtaacggtcaagaattgtaacttgttgagaacgtgttcagaataggaaaatgttcaaataatgaacaccccatattacgtcgaggaaaataaatgttttatattagaaaagccaatgaacgtggtcatgccaatcatggctggctagacagttaccatactttttcattcgccggctactatgatcctaaatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttaccaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggtactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaaaaatttttgggattcaatgttgagcaaattcaatgttcaagcaaaataaaaatgcctgtctttgatatatttcaaaagcaggcatttccacaatgttcgagtaatgcttaaaaactcaccgcacttttcagttttttcaacgcatttgtttcaagctgacgtacacgttcagcagaaatgttatattttgctgcaagatcatgtagtgttgctttttcatcatctaaccagcgtgatttaataatatctcgactacgttcatccagttcagctaaggcgttggcaacctgatctgctgcttgtgtctcaaaattttcgttttctagctcagccgcaaaatttgagcttttatcttctaaatagagtgctggtgcgtaactttcgtcatcatcaacaggtaaatcaaaaccgacgtcagatcctgtcattcggctttccatctcaaggacatcttctttggaaacgcccaattcatttgcaaccatatcaacttctttatcactgaaccaacctaagcgttgtttagttttacgtagattaaagaataatttacgttgtgctttagttgttgcgactttaacaatacgccaattacgtaatacatattcatggatttcagccttaatccaatgtactgcaaaagaaaccagacgaacaccaacttcaggattaaaacgtttcaccgctttcatcaagccgatattaccctcttgaataagatcggcttgcggtaaaccataaccggaatatccacgtgcgacatgaataacaaaacgtaaatgggacaaaatcaatgtttttgccgcatctaaatcttggtgatagtacaaacgttccgccaattccttttcttcttctgcagtcaacattgggtaatcataggctgcgtggatataaccttcgatactaccttgcggaactaacatcattgcttgtgtttctttattcattctattcctttttgtttataaaagacttattttctctatactttaagacttttaattgttttaatcaattaatatcttaaattctaatagttagaccataaatacattaaaaagttttcgtgttattttaaaattggcacaagaacatattctacattttgttcaattacttgtaataataaatcaatatttgggtgcttccccggattttctttagcatctaaaacatgttcggcaaatagttgcacgcctttttccgcacaagtgcggtctaatttaccgttaaatttttgagccaacgcattataaacacgcaaagaacctaattttccctgctcggcaggaatatgatgcacgacttgatcgtttgctaatatatctaaaccggacaagtgttcaatactgggtaagctcgttaaaattgtttggaaatccattttatttctccattattatgaaatataagcagtactatccacttcaccgttttccccaataaagcgtacttccggtcgtaaatagacgttaaattttagtattaccgtttggtgaatatgctgtgctaatttaaccacatccgcactacttgcattatctttattaataatgacgagtgcttgttgctgatgaacagcggcaccgccgatttgatagcctttaagtccagcttggtcaattaaccaacctgctgctaacttaattgtgccgtccggctgtggaaaaaaaggtatagttgggtaatcttgttgtaaaagcgaaaatgcttgtgctgaaataatcggatttttaaaaaaactaccgctattaccaaactcatcgggattgggtaatttgctttggcgaatatgacaaatttcagcaaaaatttcttgtgcgttgacttgatgtgtatcgaattcagttaatgtgccgtattttaataccggttgccaattttttgctaattttagaccaactgcggtaataaaatacccttctctgtattgccttttaaaaatactttctcgataagcaaacgcacattcttcattgcttaaacgaaatattgtatttttttgtaaatccaatacgtccacataatcacaaacatctttaaattctacgccataagcaccgatattttgaatgggtgccgatcctgcacaacccggaatcaaagcgaggttttctaaaccataaatgccttgtgttaaggaccattgcactaaattatgccaattttctccgccattaacatgtaaataatgaaagtttgcatcttgcttatgttcaatccccataagctgattaataaatacaatgcctttaaaatcgtccacaaataaaacgttacttccttgtcccaaaaataagatcggcaaagcgttctttttcgctaatttccattgctcaattaactcggaaagtgcggtgatttttataattttttttgctttagacggaagatgaaatgtatgaaagtcttgtaaattttccattaatattccttaaaatgtattcggtaaagttaatttcacttcggtaccgcctgtcgaatgattttgaatagacaaacgtgcatttaattggttactgcgttctaacataatatttaatccataatgcccggttggttcctttaaacttggaataccaatgccattatcacgcacagccaattcatattcaccgtcatcattagtataagccagcacttcaatttctgtgccttgtgaatgtttaatcgcatttaatgtcgcctctcgcacaatttgtaacgcatgaactagttgttgggcgttaaatgtttgtgaaggcaaagaacaatccactcgcattcgcattgaggtttgattgcgtaatgaatctatcacttgttctaaagcaacctgtaaatttgcctcttgtatggttaagcggaatgtggcgagaagttcacgcaactgtagataaccggcggtaactgcttgctcaaaatcttgaataatttcttggcttttggctttggcatcttgagtttcttgttgtagggtatgttttaataaagtgagttgaattttcaaataagacaatacttgagccaaagaatcatgtaattctcttgcaataattgaccgctcttccatgagtaataaatgctgttgttgtcgttgcatttggtaaaaatacagcgtgcgactgagcatttgcgagacattgtgcattgtgcgtaaatccggacaaggtaagccggcttgccaacgcataatcccaagttgattattttcgatttctaaatccatactttgtaaatcaacggggtcttgttttgttcctaaagaaatatgccaatgctctgcaccatgaacaattaattctaaataccgcaaatgttcattaatcatcacttgttttagcatttgttgaaatagtttaggttcaatggcttttgtagtaacaagttgagaacaatgataaagcatggttaaagagcggttagcttgacttaacttttgtgttttctcattcactttttcctccaacgtggcataaagtttttttaactcggctgccatttgggtaaaaactaaagctaatcgaccaatttcatcatcacttttggtgtctaacggaatatggttaaattgtccaatttgaacttgagaacttgccaacgctaatttttccaatggggtaacaactcttttgcgtgtaaaataaatgacataggataccatagctaaaatcacaatcattgctactaaaatactgagtacggcgattttaagtttcagctccgcaaaatactgtaaagtatttacaaattgatctacttgatcgacatagctggcgatttctgcacggtaagcatccttgttgttttcttttgcatgcttttccatgatctcccaacgcttgattaaattacgataggattgccttacatcattaggtacaagaaaatgccgactaattttgagtaatggctctgaatgcaaacttaaacgatattgacgcaatgccctctctacattgtccggttcatattccatttcataaaaaagtcggtaactttgcatacgtaatgagccggaaacattgattaactctgcatcagatttattactttgcataatagctaaactcattatgctaattaacgatacaaaaataatgatgagcaataaatagttggcaattttagttgaaacagaatgattttttatattcatatgaaaatctttaaacaaaatccgcacgctatcatacaacagaatatgctgaataccgcatactttattattcatgccgatggcttatcatatactgactgtattcaactttaatatcatcggcaaattccctcaaaatacgccatcaattttgctataatactccccgcatattgagggcagaaacaatggtaaaaaatagcacaatcaatcaacatccggaacaacaaaccaaagacattattgacgaaaaactcatacaagcaggttggcttattcaaacagttaaagcttataatcctaatgcaggtttaggcattgccgtgcgtgaatatcccaccggcacaggacctgtggattatctgttgtttgtggatagagagcctgttgccattattgaagccaaacaagaaaatttcgcctacaaactcaacaccattgaagagcaaagtgcacgctatgccaaaagcgaactcaaaaacattgcccaagccgacatcgcttttttgtatgaaagcacgggtaccatcacacgctttactaattgcaatgaccccacgccaagagccagagaagtattcaactttcatcgccccgaaaccttacaaaaatgggcaactgaaggcaaaaacaccttgcgtgctaaattaaaagcactacctgtactcaatccgcaaaatttgcctgcttgtgagttaaacttgcgtgattgccaactgaccgccattgaaaatatacaaacttcgcttgctaaagatttgccacgtgccttaattcaaatggcaacaggtgcaggcaaaacttatactgcgattaacattatgtaccgtttgctcaaatacacaggcaaacggcggattttgtttttggtggacaccgtcaacttgggcgaacaagccgaacaagaaatgctggtttttactccgccggacgataaccgtaaattcaccgaactttacaacacccaagtcatcaaatcaccacatatccctaaaggtgtggaagtgtgcatttgcactattcagcgtatgtattctttattgaaaggcgaagatgtagctattcctgatgacagcgttgaattggaagaatgggaaaaccgtttaaaagaacctttatccgttgcctatcaacccaatttaccgcccgaattttttgattttatttttattgatgaatgccatcgatctatttacaacttatggcgacaagtgctggattattttgatgcctatttgatcggcttaaccgcaacacccgataaccgcacttttggttttttcaatcaaaatgtggtcagtgaatatagtcacgaacaggcggttgcagacggcgtcaatgtgggcaatgaagtgtttttgattaacactaaaatcagcatacaaggcggtaaattcaaagccgaggaactggtagaataccgtgaacgtactacacgccgtaagcgttggcaacagcaggacacagacgaaagctacactgccaaacagcttgatcgtgatattgttaatcctagtcaaattcgcacaattatccgcactttccgtgatcatttgccaatcatatttcccaatcgtcaagaagtgccaaaaacgctgattttcgcccaaaacgacagtcatgctgatgacattatcaaaatggtgcgtgaagaatttgggcagggcaacgaattttgtaaaaaaatcacttacaaagctaaagacgatattttggacgaaaatggcgatattgtagagcaaggcgaggagccgaaaaccattcttgccaatttcagaaacagctatcacccacgcatagccgtgacggtggatatgattgccacaggcaccgatgtgcgtccgcttgaatgtttgctgtttatgcgtgatgtgaaaagtcgaaattattttgagcaaatgaaagggcgtggcacacgcacgcttgataaagacggtttgcaaaaagtcagtccgcccgcaccgtctgccaaaacccattatgtgattgttgatgcgattggtgtaaccaagtccttaaaaacctcaagtattcagttagacaccaagcgttccgtgagttttgccgaactgggcagagcggtggtgtttggcggagcgtttgatatggacagtattagctcattggcttgtcgtttgtctcgtttggacaaacaattaagccaagatgaacagcagcaaatcagtgaaattctaggcggtgttgccttatcacaagtggtcaaagacttgtttcacgccatcaatgccgatgaaattcacaagcatgcttgcgaacaagagggtatttcccttgatgaaacgccgtccgaagaaacgctattaaaagtgcaaaagcaacgtgttcgcaccgctactaaaacactttccatggagctgattaccgctcttgatgaaattcgcaaacagcacgaacaaaaaatcgaccacgaactggacgaagttacccatgtgggctgggcggaaaatgacgaagcgattacccaaaattttgcagattggataaatgaacataaggacggcattaccgccctgcaaattttttacaaccagccttatcaacgccaagcatttacccttgcaatgataaaagagttggcaaacgcaatcaaaaaagccaaacccaaactggcattcagccacatttggcaagcctacgcacgcctagaccaagtcagcgagcaaaaacaaaatgaactcactgcactagtcggtctcattcgtcgcgtggtgggtattgataacaaaatcacaccatttgctcatattgtgcgtaaaaatttccaaaaatggacatttgagcataatgcccgagcagacaaaaagctcaccgaagaacaaatggcgtggcttgcgatgataaaagaacatatcatcacttcattttcgataaaaagcgatgactttgaactcacaccgtttaatcagcacggtggattgggacaagcctatgatgtgctttgtggcattacccaaaatgacgattttgacgcattgcttgatgaaattaaccaacgatggacagcgtaaccgaaaacagggcaaaaataatgagcgatttaattatttaccaaaccgatgacggcaaaacccaagtcagcctattggttgaacaaggcgaagcgtggctcacccaaaatcagcttgccgaactttttgatacctctgtaccaaacataaccactcatattaaaaatatattacaagacaatgagttagatgaggattcagttattaaggattatttaataactgcgtcagacggcaaaaattaccaagtcaaacattattcattggcgatgattttggcaatcggttttcgggtgcgaagcccacgtggtgtacaatttcgcaaatgggtaaacagcacactgcaaacttatctagaaaaaggttttttgattgataaagaacggctgaaaaatccacaaggtcgccttgattattttgatgaattattagccgatattcgtgaaattcgtgccagcgaaatgcggttctatcaaaaagtgcgtgaactgttcagcctgtccagcgattatgacaaaacagacaaagccacgcagatgttctttgccgaaacacaaaacaaactgctctttgccgttacgcaccacaccgccgctgagctgattttaagccgagccgatgccgatttaccgaatatgggtttgactgcttggaaaggcaaagtggttcgcaaaggcgatgttgtgattgccaaaaattatctaacggcagacgaattggacagcctaaaccgtttggtaacaatttttcttgaaagtgccgaattgcgtgtcaaaaatcgccaagatttaaccttgtcattttggcggaacaatgtggataatttacttgaatttaacggatttgccattttggacaatcaaggcagtcgcaccaacgcccaagcccaaaccatagctcacgagcgatacgagcaatttcacgctaagcgacaagcccaaaaacttatcaatgcagacagtcaggactggcaagaattgcaaaccctagaaattgaacttaaaaaagcgaaataacccaacgatgagcaagcatacaatgaccgcaaacaacacattaccgcaagggtggaagaaatataatttatttgaaatttgtaaacccaaacaatggaaaactattgcagtaaaagatttaacagatacaggttaccctgtttatggtgcaaatggtgttattggctattaccataaatataatcacgaaaatgctactgttctactaacttgtcgtggagcaacttgtggtgaaattcacatttccaagccatattcatacataaatggcaatgcaatgtgcatggataatttatctgaaaaaataacaattgaatttctgtatttttatttaaaatcaattaatttaagttttattatttcaggttctgcacaaccacaaattacacaagttggactaaaaaaactagaaatcccggttcctccattgccaactcaacaagccatcgtcaataaaatagaaaccctatttgccgacattgatgcagggatagatagattgaaaacggcacaaaagcagttaaaacaataccgccaatccttgctcaaaaatgcctttaatggcgaactgactaaagattggcgtgaacaaaatgctgataatttgccgtcatcaagcgaattactcgcccaaattcaacaagcaagggaagctcaccacgccaaacagcttgccgattggcaaagtgcggttgaaaaatgggaacaaacaaggaaaattgggaaaaaaccgagtaaaccaaaagcccaaacacaagcggttcaatttgaagaaagtttggaagatttgccaagtgggtggggaacaatcaaaatcaatcaagtggctaatatttttacaggtgcgacaccattaaaaagtaatcctaattattatataaatggttcaattccttgggttacaagtggtagcttaaataatgcatttgtagaatgtgctgataattttgttacagatttggctttaaaagaaaccaatttaaaattattgccaaagcatactttacttattgcaatgtatggagaaggcaaaactcgtggaaaatgttctgaattattaattgaagcaacaaccaatcaagcgattgcaggaattgttctttatgaaaattttccaatcagcagacaatttttgaaattctatatgtttaaaaattatgcagatttacgccgacaatcatctggtggagttcaaccaaatttaaatttaagtttagtgggaaatattgtttttccttttccctgcttaaccgaacaaaccgaaattgtccgtattttggaaagcaaactttctgcctacgaccaacttgccaccacattaagcaaacaacttaaacaagccgaattgttaaaacaggcggtattgaaatcggcattttcggctagattggagattgatcaagggggcgataagcaatgttaaattggaatgatattgaacagatgctaatcagtggcaatctatgccaagaaaagctttatttggagtataaagaagcaaaaaacgatgtacccaaagcggtatgggaaagctactctgcatttgccaaccaatcgggggggctttattttgctcggggttgccgaaaaaccaaatctgcatatttccggcgtgggtaatcctataaaaattcaagatctcttgttctcacaatgctgaaatgtggaaaaagctagttgtgctttgctcaatagcgatgatgtccgacaatttgggatccaaggcaaaacggtgattgctgtttatgttcgcaaggcggaaacaacacaacgcccagtgcatctaaatcaagattatcgccgctcttttattcggttaaatacaggcgatcatcggctcaacgatagcgaattgcgttctttcttaatctagctatacccataaagattttgatgggcatattttaccctatggcacattggattatttgaatcgagaaaccttgaacaaatatcgccatttattaaaagcacataatccttcatcaccattattgattctttctgatgaacgctttgccaagaaggctgggattttttccattgatgccacaacaggcaagcaaggtattacctacgctgctttgctgttatttggcaaaggggaggctattaaaggtgtttttccgcattttttctttgagtatattgaaaaaagcgaagagaaccgccgttatgatctccgtattacggattttgatcttgaagatggcaacttatttgagttttacctaaaaattgaaccgagaattattgcactgggcaaggatactcatttcaaattagataaactcacacgcacggaagaaaatgaaattaccgaagcattgcgagaagccttggtcaatgccattgctcacgcagactatttcaataatgcacgccatctgaaaattgtgaaaacgaccaatcaaatcagctttgaaaatgcggggataatgttggtggaggttgagcaggcaattcttggaaaccgttccgaatgtcgcaatggcaaaattcacgacctcttacgacgtatcggcttatgcgaacggcaaggcgagggtgtgcgagatattttcgctcattggaaaagccgttatttcaacacgccaaaattagaaagccatattgatcacaccaagctcacactcacttttcaagatggtgaaattgcaaaatggcaggaaaaattgactgcttgcttgggaaaagattttctaaaacttaaagaaatcggcaaagattgcctgctttatattgccgtaaacggtcaacaagcaagccataaacacatgacagataaaatgcctcagtattcttctcgtgccattacccttgctttagcacagttaaaaaataaaggtttattaagtgtatcaggtgaaaaacgtagtgaccgtgtttatcatcttctagagctaattgcagataagtcaaaatgtgattatgtggataacagcctaaccgtacaagataaaactattgaaaatcaaatggttatagagaataactcgttgggttatatacaagataggatacaagataggatacaagataatcttgcttctttgttggaaattttaaatgatactgcgtacagtacgagtgaattattaacattgctggcgttaaaaagtcgtccaagctttgtcaaaaattatcttaataaagcattacaggcggagttaattgaaatgactattcctgacaagccaaccagccgtaaccaaagatatcgattaactcggacaggtaaacagcttttagcaaaattgaaaagagacacacaatgaccatacaaacacacacctcaaacgccattgtccaaaaagtttggagtttttgtcatatgctccgtgatgacggcgtgagctatggcgattatttggaacagattacctatttgattttcttaaaaatggcatttgaatacagccagccaccctataagagaaatgtcggcattcctactgaatacaactggcaaagtttgattaaccgttcggggatggaattggaaagtcattatttggcattattgcgtgatttaagctagaaaaaaggcttgcttgggcagattttcgccaaagcacaaaacaaaattcaagaccctgccaaactttctcgtttaattgcgatgatagacgaaaccaagtggacccgtttaaatactgatgtgaaaggcgatatttacgaaggtattttggaaaaaaatgctgaagacactaaatcgggagctgggcaatattttacaccacgagccttgattgcagcgattgtagaatgtgttcgtccgcaagccgatacgatcattgctgacccggcagcgggaacaggcggttttttattggcagcatacagttatttagaaaaacataccaatttaaacgctgaacagaaagtgcggttaaaaaaagggactttttttggcaatgaaattgttgccaatacccgctgtttgtgtttgatgaatttgtttttgcacggtattggcgaaatggacggtgaaagtccgattagctctgatgattctttgcttgcaccaagtagtcgaaaagcggatttggttttagctaatccgccctttggcaaaaaaagcagtatgacgtttaccaatgcggacggtgaagctgaaaacgaagattttgtttataaccgtcaggatttttgggcaacaactgccaataaacaggtcaattttttgcaacatatttacactatgcttaaaaacaatggtcgtgcggcggtagtggtgcctgataacgtgttatttgaaggcggtgcaggcgaaacggtgcgtaaaaaattgttgcagatgacggatttgcacactattttacgtttaccgacgggtattttttatgctcaaggtgtgaaagcaaatgtactgttttttgataatcgcccaactcaagaacaggcggttaccacagaaatttgggtatatgattaccgcactaatgtgcatcacactttaaagaaaagaccaatgcaattgactgatttacaagactttatcaattgctattgtgctgatgatcgccgtaaacgtacggaaacctatcacgccgataacaatcctgacggtcgctggcgtaaatttacccttgatgaaattaacaagcgggagaaaaccagtttagatattttttggttaaaagatcgttctttgaccgacttggatcatttgtcggaccctgatgtgttagccaatgaaatcatagaaaatatggaaatagctttgatgaattttagacgtgtagcacaggaattgatagataaatgaaatgagttgtcctcaaacaccgtttacagaaatgtaaacggttttttaaataaatcaatgatatatcatttttctcaagcatatccgcaattccacgcttcgtaacttcctatactgaaatcataaatttgatctacctcaacaaacttgcattttgtcgagcaaatactcatttttggttattaaaaatcagcggtaaggtttggacaataaaaatctataaaagaatagtgtggtttttaggcataacgttggtggaagaacagttatccggcaacgataacaacctcaaaataagaaagaatatgaaagaaaataaaaacgcaaaaaatcatgctgaggagtggcatgtttgtggcttaattattcaagtaaacccacaaaaaatagcacaagttaagaccgctcttttgacgattccgcatacggaaattccagcagaggatgaaaaaggaaaattggttgtggttatgcaatcggacgatccgcaggttttactgaatcatatggaaaattcacgcaatattgatggcgtgattgatttgtcgctgatttatcatcaacaagatgacaatgttgagcaatagtttaaaaatgaatagtgggggagactatgaatttaagtcgtcgtgattttatgaaagcaaatgctgctttagctgccgcttcagtggctggcttaattattccggtaaaaaatgtaaatgcagctgacacaagtattacttgggataaagccgtatgtcgcttttgcggtacaggatgtgcggtattagtggggacaaaagatggacgtgttgttgcttcgcaaggtgatcctgatgcagaagttaatcgagggttaaactgtattaaaggttatttcctacccaaaattatgtatgggaaagaccgtttaacgcaccctatgctacgtatgaaaaacggtcaatatgacaaagaaggggaatttacccccgtaacttgggattttgcctttaaaacaatggcggaaaaatttaagtctgcattaaaagcaaaaggaccgaacggtgtaggtatgttcacctccggacaatccactatttttgaaggtgtggcaaaatcgaaattattcaaagcaggattactttcaaataatattgatccgaatgctcgtcactgcatggcatcggcagctgttgcctttgtacgtacctttggtatagatgagcccatgggctgttatgatgatattgagcatgccgatgctttcgtgctttgggggtcaaatatggcggaaatgcacccgattttatggtctcgaatctcggatcgccgtttggctaatcctgatacggttagtgtaaatgtcctttctacctttgagcaccgctcttttgaacttgccgatttaggtattcttctcaaacctcagtctgatttggctattttgaactatattgcaaattatctcattgaaaataatgcaattaatcgagagttcatcgaaaaacataccaaatttaaacgtggcgaaactgatattggttatggtttacgtccacaagatcctcgtgagcaaacagcgaaaaatgttaaaactgcgggcaagatgtatgatagttcttttgaggaattcaaaaaattagttgcaccgtacaccttagaaaaagcacatgaaatttccggagtaccaaaggagcaattagaaaaactggcaaaactttatgccgatccaaataaaaaagttgtttcttattggacaatgggtataaaccaacacacacgtggtgtatgggcaaaccatttaatttataacattcatttattaaccggaaaaatttcattaccggggtgtggtcctttctcattaacaggtcaaccctctgcttgtggtactgcacgtgaggtgggtacttttattcatcggttaccggcggacttagtagttattaaaccggaacatcgtaaaatcgcagaaaaaatttggaaactaccggaaggtttgatttcagataaattaggcttccacgctgttgcacaaagtcgtgcattaaaagacggcaaaatgcaggtgttatggcaaatgtgtaataacaatatgcaggcaggtccaaatatcaatgaggaaacttacccagggtggcgtaatccggataactttattgtcgtttcagatccctatccaaccgtatccgcactttcagccgatttgatcttaccaacagcaatgtgggttgaaaaagaaggggcttatggaaatgcggaacgtcgcactcaattttggcgtcaacaagtgaaagcaccgggtgaagcaaaatctgatttatggcaattagttgaattttctaaatattttacgactgatgaagtatggccggcagaaattttagcgaaaaatccggcataccaaggtaaaacactttatgaggtgctttatctcaatggacaagtaaatcaatactcaaatgatgaactgaaaggtcgcctaaatgatgaggcttaccattttggtttctatatacaaaaagggttatttgaagaatacgcaagttttggtcgaggacatggtcatgatttagctgattttgacacttaccataaagctcgaggcttgcgttggcctgtagttgacggtaaagaaactttatggcgttatcgtgaaggttatgatccttatgtaaaagcaggggagggtgtttctttttatggtcaggcggataaaagagcggtgattttagcggtaccatatgaaccgccggcagaggtgccggatagaaaatatgatttatggctgaccacaggtcgcattcttgagcattggcatacaggatcaatgacacgtcgtgtaccagaattacaccgttctttcccgaataaccttgtttggatgaatccgaatgatgcgaaaaaacgtggtttgaaacatggggataagattaaggttatttctcgccgaggtgaaataacgtcttatatagatactcgtggacgtaataaatgtcctgaaggtttgatttatacgactttctttgatgctggacagctggcaaataaactgatattagatgcaacagatccgatttcgaaagaaactgacttcaaaaaatgtgcagtaaaagtggtgaaagcgtaacaatcaacaaaaggcaccgcactttacttgctaaagtgcgatgaatactcatgaagaaaattgcttttacaccggaacgccgaaaatttttaagagataccgtccgaacctgtggcggacttgccggattaggcgtattacttggcttacaacaacatcaaagtctggctagacagggggtggcattacgtccgcccggtgctttggctaatgaccaagattttacagcggcttgtattcgttgcggtcaatgtgtacaggcttgtccttataaaatgctgcatttagcctcattattatcttccatagaggcaggaactccctattttattgcaagagagaaggcttgtgaaatgtgtgaggatattccttgtgttaaggcttgtccgagcggtgcattggataatcaacttgatgatattagtaaagcaacaatgggattagccgttttgcttgatcacgaaacctgtttaaactggcagggtttacgttgtgatgtttgttatcgtgtttgccctttaattgataaagcgattacgttggaaaaacatcggaatgaaagaacaggaaagcatgctgtgtttattccaactgttcactccaatgcttgtacaggatgtggtaaatgtgaagaggcttgtgtattggaagaagccgccatcaaggttcttcctaatacattagcaaaaggtatgttgggagaacattatcgtttgggctggcaagagaaagataaagtagggcattctcttgcaccaaaagacttaatatccttaccaattcgtcaaccggagagtaaataatggcaaattctcctaaacacagcggtagagaatcaagagaaaaattaggtttttggcgtgcaaaccggttcctcattttacgtcgggtaactcaattcaacattctcaccatgttcttgagcggaccttatttaaacttttggattctaaagggtaattatagtggtagtttattattcgacactatcccattaaccgatccgcttattgtcgccgaaagccttgcaacaggctatttaccgaacagttcaacgattattggaacaattattgttgtatcaatatatgctttacttggtagcaaagttttttgtggctgggtttgtcctcttaatgttgtaacggattgtgccgcttggttacgtcgaaaattaggtattcgtcaaagtgccaaacttcctcgtggcttgcgttatggtattttgctgatgattttaatggggagtgcagtaagtggcgtattgttatgggaatggataaatcctgtttccgctttgggacgtgcgttaatttatggggttggtgcaacaacttggttgatattggcagttttcttatttgacttatttattgtggaacatggctggtgcggtcatctttgtcctattggtgcaatttatggtgtgattggggcaaaaagtttattgcgtattaaagtagttgagcaacaaaaatgtgatcactgtatggattgttaccatatttgtccggagccgcaagttttacgtgcaccgctacacggtaaaaataatgaaagtcggtttgtactttcaaaagattgtatcagttgcggacgttgtattgatgtctgtgctgaaaaagtatttatatttagcaatagatttaatcattctgggagtgatcaaaaatgatgaaaaaaacactattatttattaccgcactttttgtgtcttctgcttttgcaacgcagaaagtaggaaaaaactaccaagatgctgttgaaaatgtgccagctgcatttcataaccatataaaagaaagtacaacgcccgcattaaactatgtaaatcaaccacctatgatcccgcatagcgttgcaaattatcaagtaacaaaaaatacaaaccagtgtttaaattgccatagtccggaaaactcgagaattaccggagcaacaagaattagtccaacgcattttacagatcgtgacggcaatgttaccggtcaaactgcaccacgacgctatttctgtttacattgccacgtatcgcaagcagatgttgctcctattgtgccaaatgaatttaagccaatgaaaggctatggtaactagatgaggatagatgtatggcaaatgaaaaatcaaatatcatcgttcgtttaagtaaaagcggttggaaatggtttaggaagccaagtcgtgctgtcagtgtattgattttattatcatttattgcaggtattattttttggggagggtttaacaccgcatttgaatacacgaatacggaagaattttgttccagttgtcatatgaatgacgttgtacctgaatatcgtcattctgttcactatatgaatcgcagtggagtaaaagccgactgtgccgactgtcatttaccgcacgaatttattccgaaatggacacgtaaaatcggggcggcaaaagaagtttatgcgtatattacaggcaaggtagataccaaagagaaatttgaggcacatcgcttagaaatggcacaacgtgaatgggctagaatgaaagccaatgactcacaagaatgtcgtcattgccataatttcaatgatatggatactactcagcaaaaaaatgtcgcacaaaaaatgcacagaatggcacaagaacaaggaaaaacctgtattgattgtcataaaggtattgctcaccaattaccgaatatgaaagacgtgcaatccggttttttacctgagcaatagtgaaaaaattgaccgcacgttgagttgcacctcaaacgttggatacatccgactgattgaggtgcaacattgtgactatttgattttaaattatttatcctaatgcaactctcgcattttggaataaacgcatccaagccccgtcttcttgccaattttcaggataccaagaattgtttactgctctaaatacacgctcagggtgtggcatcataatagcgactcgtccgttggaattagaaagtgcggtaattccctccgcagatccgttcggatttgccggatatatttctgtcggatttaactgactgtcgatatattgtgcagcaatcaaattctgtgcttttaatgcttgcaactgctgatcatgcttaaattcaattcgtccttcaccatgagaaaccgcaatcggcatatgtgatcccgacattccgttaaaccatacggaatgagtatcgttaatgcgaaccattgcaacacgagcttcaaaacgttctgatttatttcgtacaaatcgtccccagttttccgtaccgggtataatttctgctaaattggataacatttgacaaccgttacaaacacctaaggctaatgtgtcctgacgatggaaaaatgcactgaattgatcacgaagtgcagtgttaaacagaatggatttagcccaaccgccaccggctcccaagacatcgccataagaaaaaccaccacaagcaacgagtgcgttgaaatcctgaagatggtgacgtcctttttgcaaatcactcatatgaacatcaatggcattaaatccagcacgatcaaaagctgccgccatttcataatggctgtttaccccttgttcacgtaaaatagcaatacgaggttttgttcctttgtggatataaggtgcggtgattttttcatttagatcataggtcaaataagcggaaagtcctttatcattcggatcttttttcatctcaaattcttgatcggcacaatccggattatcacgtaaacgttgcatttgatgtgttaattcagcccaaatcccacgtaatacggaacgtttttcactcaataagactctggtactgcgagtaatctcgatatgatcatctgcggtaacaataccgagttctttggttaaatgaattaatccatgttcggtcaatacggcacgcaccgctttaaggtcactttctttgacttgaattacggcacctaattcttcattgaataaaacaccgagatcattgtcacccaatgcactgatgtctatggaaataccgcaatgaccggcaaaagccatttccgcaagcgtaacaatcaaaccaccgtccgaacgatcatgataggccagcaatttctcttgtttcacgagagcttgcattgcattaaaaaagccttttagcaaagacacatttaccacatctgccggtacatcgcctaattgcttatacacttgagcaagtgcggttgcacctaaacgattttttccctcacctaaatcaattaatagtaatcggctatctcctttgtccagacgtaattgaggtgtaaccgtcttacgcacatcttctacacgagcaaacgcactgataattacggaaagcggtgcggttacggatttttgatatccttcttcctgccaagtggttttcatagacatggaatcttttccaaccggaatggttaaacctaattgagggcataattcctcaccgattgcttttacagcctcataaagtccggcatcttcgccgccatgacctgcggcagccatccagttagcggataatttaatccgtctaatattgccgatatccgttgcggcaatattggtaatgctttctgcgacagctaaacgtgcagaggcggcaaaatccaacaaggcaacaggagttcgttctccgatagacattgcttcaccgtgataactgtctaaacttgctgttgttaccgcacaatccgccacaggtacttgccacggaccgaccatttgatcccgtgctaccatacctgttactgagcggtcgccgatagtgattaaaaatgttttctctgctacggcaggtaaccgcaataccctgaacaatgcttctttaatttggatcatagactgatccaattggggattattgacttttgcggatttcacatcacgtatcattttaggggttttacctaacaagatgttcattggtaaatcaataggattgttattaaaatggctatcttgcaaagttaactgctgttgttccgttgcctcaccaatcaccgcaaaagatgctcgctcacgctgacaaatcgcttcaaagagcggtaatttttctggtgaaacggctaaaacataacgttcttgtgattcattgcaccaaatttctaacggcgacattcctttttcatcgcataaaatttttcgcaactcgaatcgaccacctcgaccaccatcatgaactaattcaggcatcgcattagataacccgccggcaccgacatcatgaataaaaagaatggggttttctgaacctaattgccaacaacggtctattacttcctgacagcgacgctccatttccggattatcccgttgtacagaagcaaaatccaaatcttcttttgactttcctgatgccatagacgaggctgcaccaccgcccagaccaatattcattgctgctccgcctaacacaattaatttcgcaccaacaggaatttcgcctttttgcacatgttcatgacgaatattacctatcccgcctgccagcataatcggcttatgatagccccgcacttcttcgccgttaaaactgttgactttttcttcataagtacggaaataacccaataaagcaggacgcccgaattcattattgaaagcagcaccgccaagcggaccttcaatcataatatccagtgcggaggcaatacggctcggtttactcaacgcattttcccaaggttgcggaaaattcggaatacaaagattagacacggagaaaccgactaaaccggctttcggttttgcaccacgtcccgtggctccctcatcacgaatttcgccacctgaaccagttgcagctccggggaaaggtgaaatggcggtagggtgattatgggtttccactttcatcaaaatatgcgtgtcttcttgatgataacgatattgcccgtcttggtcagggaaaaagcgtccgacttttgaaccttccatcaccgcagcattatctttataagctgacaatacataatcaggcgttttctcaaaggtgtttttaatcattttaaacagcgatttatcctgtttttttccatcaataatccaatctgcattaaaaatcttatgacgacaatgttctgagttcgcttgtgcaaacatataaagttcaacatctgtaggattgcgaccgagtgcggtgaaattttccactaaataatcaatttcatcttttgctaatgccaatcctaaagtcacattcgccttttccaatgcaacatgcccaccggttaaaatatctaccgtggtgaaaggttttgggtcatgctgttcaaataaaacagctgcttcttgtggagaacggacaatactttccatcatagggtcgtagatacggaatactaattgttgttcttcttcagccgttaaagtgcggttaaatttgaaataataagcgataccacgttccaaacgaagtaccttatttaaatcacaattatgtgcaatatcagttgcttttgatgcccaagaagaaatcgtacctatacgtggaatcaccacaaaacattccccataaggctcttgcgatttctgagtcggaccataacgcaaaagctcctctaatttttctctttctacctcagttaatgcttcacttaaatgggcaaaatgcaaaaattctgcataacaagacacaatgggtaaattatcttgctgaaaaccactgaataactgatttaaacgaaaattggataatgcgggcgtaccacgaaaaatgtgtaacatagaaaagatccatcaaaaaaataaaaaacgaccacattataaaggaatttttatcggaacgaaaacgtttgcctaatgcaattttcaaaaaatagttaataaaaagctgataactgaaatgatctgcaccccaaaagttggattaaacaactaactgatgaagtgcagatttttttaggattaattttttggtaaatatctcattggatctactgattgacctttataacgaatttcaaaatggagtttgattgtgtttgttccagaacttcccattttagcaatttgttgacccgctttaacttcttgctgatctttgacgagtatactttcattatgtgcataagcacttaaataactgtcattatgtttaataataattaaattaccatatccacgtaaagcgtctccggcatatacaactcgtccagcagcagctgcattaacagcttgtccacgagaaccgctaatatcaatacctttattgcctccatcagcactggaaaatccttgaataatttttccatttgttggccaaatccaagctatatttgaggtggctggaggtgttttattgattggcattgttgaatgtgttggtgtagcaacggggttcatttgttcatttgttggtctattagcattccatgtctcattgactgtattttgtgtcacctctgattcatttattgtctgtgttggtatcatattgctatcgggaatattatttgcaattttcaatatttgtccaatactcagatgatatggttcagacatattatttagtgtggccaattcttttatatccatgcctgaaatataagcaataagaaacatggtatcgcctttgcgtactttgtaagtatcacctttgtaaaaacccttatcaattttgctataaacaggcacattagttttaggatctcttggaatttcaaaattttgtagagcctgtttttttgctatcgattctgttttttgttgattttgttgaatgatttcaggttgataagtggaatttgttgctttcggcactctcatactttcgggcatcttttgttgaataacttgaggttcccaagcggttgagtttgtaccattaatcggtttgataatacttggtgctaaatccttagcattttctaccggagccggagtgtgtgaactacaagcagctagtacagtgatactaatagataaaggtaaaaattttttcatgtaaattctccgttactttatattcattttttatcttagattatttcaagacaagatatacaactatagcaataatgacaactgaccaaccgataaattcaatagattgacgtaatttcgcagcaaatttttttccgctccaagccgctaaatgggtaacgagcaaaaatcttgcaatacgagaaataaaggcagtaagtaagaaaggcaaaaatgccatttgcatgacgcctgcacaaatcgtaaaaattttataaggaataggtgaaaaacctgcaacgaaaactacccaaataccccattctttgaaccaagaaagagcagtttcccaatgttgttgataaccccattgttgaatataactttgtatgaaatcaaaagcgtaataacctaatccataaccaattgccccaccaatggctgaagccattgctgcataaaatgcaaatttagtagcacatttaggtttatttattgacatcggaataagcatgacatcaggtggtattgggaagaaaatagcctcaataaaactaacaaaagttagccaaaatgtagcaaaacggtgatttgcccattgcatagttttatcatatagcgtaccgaaaattttcatgttttattccttcgatgaaaagattatcgttattccttatctaaccattgttgtaaagctgtcattgaatgatatgccgtcatatctgtttgaatgggtgtaattgacacatagccgtttttaacggcatggaagtccgttccttccgattcattttctgccagtcctattggtccaatccaataaatctcttcacctcttggatctttttgtttaataatatccgctgcagctgcacgatacccaagatgacaaactttaataccttttatttctgaataggggagatccggcacattaatattaataatttctcggctttttaataatcgtccatatagtttaggaataagttgactcacaattattgccgcactttcataatgttgtcgtccatctaaagaaactgcgattgcaggtaagcttaaatggcgaccttccagtgcagctgcaacagttcccgaataaataacgtcatcacctaaattgactcctgcattaatacctgaaacgacaaggtcgatctgaccggataaaaaaccgttgagtgctaaatgtacacaatctgcgggagtgccattgatactataatcaccattatccaatttcattggtcgtaaaggctcaacgagtgtgagtgagcttgaagcagcactacgattacggtctggtgcaacaacagtgacttgtgcaaatttacgtaattctttagcaagagttttgattccctctgcctgtatgccatcatcattagaaagcagaatatgcatattgtttcctatgttttaaattattattcattaatattaaccagttctcttacgagggctgtcgcataacttcctgctggtaaataaaaagtcagttttaatccctcaggtataaatgaccagcttaagtgttgagcttgcataagtattggacgacgtgccgatttcattttttcctggtgcattaagtacaggagttcttgatgtttagcgataatttcattttctacatcactggcaatttgtacattttcaccaattaatggtgcagtgatttgaatatcctgttgtgctaaacgttgttgtaataaattaaaatcttctttttgatcagcatggaaccaactgtgtgagccggataactgcaaaatatcatttactaagattttatggtgtagaccttgtcgaatacgagcggatacaatcaagttaaaaatttcactacgagcagcggagagataaaaactacgctttttgcgatctttaacgttaatttcacctttagcccagcgtaaagcctgagttaaattgtgtccatctcgtccgaaacgttgctcggtaaaataatttgggaacccatttttcttgatattttctaaccgcactttgagatctgcatcttcttgtgcttcacgcagtaaaatttcaaaatggtttccgtccaagcttcctgtgcgaatttttcgattgtgacgtgttacctcaaggatttccacaccatcaagttgaaattgattaaagtcaggtgtgggttgtcccggcatctgtaaacaaaaccattgttctgtaatcgctttacgatctttgagtcctgcatatcccatatttttagcaggtataccagcaaagtgtgccaatttttctgcgacaaatagagtattacaatctgttttacgcactttaacagcaacaaattcgccatcaccggacatttcatagcccagttgttctttcacaacaaaatcagcacagtgtgtttttaaaagtgcggtctgttttggcattgtttgtaaataagcgagttcgttcattactttgtgccattttgttttattaataggacaacagcttcacaagcaatgccttcactgcgtccagtgaagcctaatttttctgttgtagttgcttttacattaacctgttcaatatcacaatgtaagtcctgtgcaatcacagtacgcattgagtcaatatatggacgcatcttgggagcctgtgcaatgatagttatatcaacattaccgacttgatagcctttgtctaaaattgcttggtaggctgttcttaataacctgcgactatcagcacctttatattgtatatcagtatctgggaataattttcctatatctcctaaagccattgcacccagtaaagcatctgttaatgcgtgtaatgccacgtcgccatcactatgtgcaactaaacctttttcataagggatagcgacacctccaatgataataggaccttcaccaccaaaggcatgtacatcaaagccatgaccaattcttatcatattttttcctaattaatgctcttttttcataatttgttggatttcagccatcatttcttggtcgacatctaaggctatttgaattaattctttattttcaaagcgagagagttttggatcataaacctctgccatcagtttcacgctatgacaatcttttctaaaatacacatcaccaatttctgctactatatcttcgttcatacctaaagagagtaaggcttgtttacttgttcttaatgccgagtcaaaggtttcacgaatttgaatattggcacctgcaccatacagattgtaaacatgaatacggtcgtgagcacgtgcaataattttaatttgtgggttcattttacgagcttgctcaacaatttgtagagtttgttctctgttatcaattgctataatcaataattcggcattttcgacacctgcagcatgtaatagctcaggacgagcagcatctccatagtagcatttaatgcctaattttttcataccggcaattaggtttgcgtctttatcaataatagttgggtgatgccccgtcatcactaacattctatttacaacttgtccaaaacgtcctagaccaattagtatagttggatgttgttcatcaatatgatccgcttttctttccggttgagtcggtttgagacgaggaattatgtatttcttttgagcaataataaagagcggtgttaaaatcattgaaagtacaacaatagctgtcatattcgcttgcatttcttcactaataacattttggctggcagccgcagagaataatacaaaggcgaattccccaccctgtgccataataaatgctcggtcaatagaattagcattaccggtttttgtgattaaagcgattaaataaattataaatcctttcactaacatgaaaagtagtacaccaaaaataattaagaaccaattttcagcaacaacagaaaggttgagtgacataccaaccccaagaaagaacaagcctaacagcaaccctctaaaaggctcaatatcagcttcgagttgatgacgaaaactggattctgaaagtagcactccggctaaaaaagcacccatagccatagagaagcccccctcttccataagtaaagcagagcctagaacaacgagaagagcagctgcggtcattacttctcgagtcttggttttagccaacattttaaataatgggtttaagagccaaagtccggctgccactaaaacagcaaaagccgtgccggatattgcaattttatgccaaagcggatcagttgaagtaactttatccggcgataaaaaagccacaaaagcaagtaatggaacaatgagtaaatcttcaaagagtaaaatcgaaataatacgctgtcctcttggagaggtcagatcattacgctcactcagttcttgcattacaattgcagtagaggtcaatacaaaaccggaggcggcaacaaaagcaactttccaatcaaagccaaataaagtagcaatataagttaaagcactggtacaaagggtaatttgaaatgcacctaagagaaagatatagttacgtagtccccagatatgagagggtttcatttcgagtccaatgatgaataaaaacatcaccacacctaattctgctatatggattattccctctggatctgtaaagagaccgaacccaaagggaccaataactaaaccggcggctaaatagcccaatactgaacctagtcctaagcgtttgaatagaggaaccgcaactacggccgccgctaaaagcgtaacaacgctaacaagtgggtttgccccttctgctaccataataattacctttgttttctagttaaaaaaaattctgccaatgccaagtcttcaggacgtgttactttaatattatcactatgtcctgctactaagtgcggtctaaatccggcaagttccatcgctaatgcttcatctgtgacgataatacctcgttttgctgcttgctctagagcgtgttgcaataagtgtacagggaaaaattgcggtgtttgagccaaccataattgattacggtcttctgtacattgaatttgcaatactgaatttgatcgtttaatagtatctaccgcaggaatggctaaaatagcaccattttgatcttcaacttgtagtaatgtatctaaatcttcattgcgtaaacaaggacgtgctgcatcatgcacaagcacccaggcttttttatttttaaggtgacgtaggccgtttagcacggattccgcacgattctttccgccaataaccatattgatacgaggatttcgcaataactcaatatcaattaaataaggatcattttcagcgacagataaaacaatttggctaattttttcgcaactcaaaaaaatacttaatgtatgctctaaaattgttttgcccagtatctttaaatattgttttgggcgatctgcttgcatacggcaaccaatgccagcagcaggtattatagcaacaatttctctatccatttatctattcttattttttactatacgataaaaaacttcattttgcttgatcatttcatgttccattctggctctttcctcgattgcttctataccattcttcagatcctgaatttcagcaaaaatagtttgattacgttgtgacagctttttgttttcttgtttacgttggataatttctgctttgatatcttgataatcaagatagccattttttccaaaccaaaaatcatactgaaacataactaacaaagcgaaaagacttaaaataaataaacgcatttttatctcttatttttcataccaaattctatttatgtacaaagaaactatacctgagggagtggctactttgatttcgtcatcgacttctttgccaattaatgcccgtgctacagggctatcaatggagatccaattctttgcgggatcaaattcatcacagcctacaatgcgatattgtttttcctctccttgctcatcttctaaggcaacccatgcaccaaaaaagactttaccttcttgctttgggttatagtccacgatttgcaatacttccaagcgtttcattagaaaacgaactcggcgatcaatttctcttaaacgacgcttgccgtaaatatattctgcattttcactacgatcacccaaggcggccgcatcggaaacagcttgcgtgattttaggtcgttcgtctttccataaatattttagctcttgatctagaatattccagccggaacgagtgatataattagatttaggcattgtatctttcctttcaaagagagcgaaattgtaacataagatcaataataaatatgtgaagaatagttaaaattacagttaattttacaattttttccaataattgtttgaactattacgttaaactcagtatgctactgcgaattttttaaacagaatataatagaaatagagacaagatgttaaatcaacaaatcgccggtattattgcgaaagaattagctgttctgccaagtcaaattttatcggctatccaattattagatgatggcaatacaattcctttcattgctcgttatcgtaaagaaatgaccggtggattagatgatacccaattacgtcattttgaaacacgtttaatttatttacgtgagttagaagatcgtcgccaaacgattctcaactctattgaagaacaagggaaattgacagatgaattgcgtagtcaaattgaacaaacgcaaagtaaaactgaattagaagatctttatttaccgtataaaccgaaacgtcgcacaaaagggcaaatcgcaattgaggcaggaattgaacctttagctgatttgctttggaatgcacctgagaatgaaccagaaatcgttgcggcagattatatcaatgcggaacaagggtttgcggatataaaatctgtgcttgatggtgctcgttatattttaatggagcgttttgccgaagatgcacaattgttagcgaaaatccgccaatatttacagaaaagtgcggtactggtttccaatgttttagaaggcaaagaggctgagggagaaaagttccgagattattttgaacatcaggaattactccgcaatgttccttctcatcgtgctttagctatgttccgagggcgtaatgaaggctttttgcaattaaggttgaatgcggatcctgagcaagaagaaggtgttcgtcatagttattgtgaagaaattattcgagagcatttgggtattcatttaactcagcaaccagcggataagtggcgtgagcaggttatctcgtggacttggcggattaaaatctctttacatcttgaaactgaactgatgagcagtttacgtgagaaagctgaagatgaggcaattgatgtttttgcccaaaatctaacttcattattaatggcagcacctgccggagcgaaaaatactatggggctagatcccggtttaaggacaggtgtaaaagtcgctattgttgataatacgggaaaactagtggcaacagagacggtttatccacataccggacaaatgaatacggcaatgtcagttatttatcaattaattaagcaacataatgttgagttaattgccattggtaacggcacagcttcaagagaaactgaacgatttgctaaagatgttattaataaaattgagcaaaataaaccacaaacagttgtggtcagtgaagcaggtgcatctgtttattccgcatcagaattagcggcacaagagtttcctgaactggatgtgtctttgcgaggtgcagtttctattgctcgccgtttacaagatccactggcggagttagtgaaaattgaaccgaaagcaattggcgttgggcaatatcaacatgatgtaaaccaaactcagcttgctcgtaagctagatgcggtagtagaagattgtgtaaatgccgttggggttgatttaaatacggcatcagcacctttacttgctagagttgcgggtatgactaaacatcttgcacaaaatattgtggcatatcgtaatgaaaacgggcgttttgaaagccgtaatcagttaaaaaaagtaccgcgtttgggtcccaaagcctttgaacaatgtgccggttttatgcgtattgcacaaggtaaaaatccgcttgatgcctccggtgttcaccctgaggcttatcctgttgttgaaaagattttacaggctacggaaaaatctattcaagatttaatgggaaatgtgagtgctgttcgacaattagatgcaaaacaatttactgatgagcaatttggaatgccaacagttttagacattttcaaagagttggaaaaacccggaagggatcctcgaggtcaatttaaaacggcagtatttatggacggtgttgaagaaatcactgacttaaaagcaggtatgattttagaaggatctgtaactaacgtaacgaattttggggcatttgttgatatcggtgtgcatcaagacggtttagttcatatttcatctctttccgacaaatttgtggagaactctcatgaagttgtgaaaacaggcgatattgtgaaagtcaaagtgttggaagttgatgttgcccgtaagcgtattggactaaccatgcgtttagatgaaaatccgtccaaaaccgaccgcacttcagttaaaacgacctcagtccatgtaaaagaagtgaataaaaatcggaaaagtagcaataatgttatgggaaatgcgtttgccgatgcgttaaaaaattggaaaaaatagttttagtacagggtatttgggtattaagttatgatgggtttaattgtataacacaggaaattttatatgaataaaaacactttttttgtaggctttatgctgtttgctatcttttttggtgcagggaatttaatttttcctcccaagttgggatttgatagcggatctgaatttattccttctattttaggctttgtattaacaggggttggcttaccgctattgggcatcgttgttagtgcattttataatggtggatacaaagaagcacttaaacaaattcatcctgcattttcattaatttttttaattgcgatttatttatctatcggccctttttttgccggaccaagaaccggtgcaacagcttatgaatttgtgattctaccttttatgggggaagcaacatcaatttctaaactggtattctttgcggtctatttttcattgactttatggctaagtttaaatccgacgaaattagtcgatcgtatcggctctattttaacgcctattttattggtagcgattatcgcattagttatccgttctgtttttttattaagcggacaggatattccaagtgtaacggtgaatacatcaggtagcttttttaatggcgtgattgagggctactttactatggatgccttagcatccgttgctttttctgtggttgtgttaaatgctatacgaaataaaaccgacctaagtgtttcattaaaacagcaaacaatttttgctgcatttattgctgccattgccttgggtttaatttatgtagcattaggatggattggaaacaatatttcaattaatgcggatgtattagctgatttgcaagccaaaaaacaagaccttggtacttacattctaaacgatgtaactacattagcttttggtgagttaggtcgtacgttgttaggaattatcgtttctcttgcttgtttaacaactgcggtaggattagcggttgctgtgagcgaatattttaatgagatttatccgaagatttcttacaaaacctatgttgttttattttgtttagtgagttttgtaattgcaaatttaggcttaaaagaagttattagtttatcattacctgtattgctaatcctttatcctattgcaatgacagtgattttgttgctttttgttaatattattttcccgacgccaattttagctcatcgcttatctttaggattggtgactgtcgtgtctgttttatcggtatttggggttggaaaaattgagtttatagagcaacttccactaaaaccttactctatggaatggctaccttttgcattggttggatttattttaggatgttttttacacatattcttcagtaaagaaaaatcagtgttaaaaagataagatataaaaatgagggcatattcaatgcccttattttctagtagtaagagtgttcaccccgctggtgttcagttacgtcttttacacctgtcaattcatcggcaaacattgctaataattgtttttcaatgccatcttttagggtgacatctaccatcgaacagccattacaccccccgccaaattgtaaaatagccttgccatctttggtaatttcaatcaaggtaatatgcccgccatgtcctgccaattgaggattgatttgcgtttggatagcatattccacacgttcaatcaatggtgcatcatcagctactttacgcattttagcattaggtgcttttaaggttaattgagaccccatttcttcagttatataatcaatttcagcatcttctaaaaaagggaaactgacttcatctatgaaagcagaaaactcactgtattttatttcatgatctgttgtttctacggcatttttagggcaataagacacaccgcattctgcattaggagagcctggattaacgacaaaaattcggatatttgtaccttcttcttgttgatctaaaagacgacgaaaatgtgcttgtgcagcctctgaaatggtaatttgcataaattaatattcctagcaatacttgagtaaaattatcaggaatgatactcctagaccgctcttttttccagtaatattacttagtttttatgttaagtttttgccagtccccatacatgaataacgttaattcctgcttgttttaatagttttgctatttcatttaatgttgagcctgttgtaataacatcatcaattaaagcgatggaatgatattgttttgctcgcttaatattcacgttaaaagcgttgtgtaaattagagcgtcttgctttttcatttaatcctcgttgcatttttgtgtatttttggcggacaaccagtttattatccagtggaatcgaaagttggcgtgaaagttgtttagcaattaagtacgcttgattataccccctgtaccattgacgaaaatgatgtaacggaacaggaacaatgacttcaggcaaactgaataaatactctcttcttgcatggtaaatcgctaacaacattaattgtgccaaagtgcggtctaaataatagcgattttgaaatttgaattgatgaataagtgtggataaaggtggttgatagcgtccaataactaccatttgttgccaatttggtgattgttttgcacaattcccacaaaacatctgtcctctaaaggcttgattttttgataaaacagcaccacaacgtccacaataatttaagcgagaaatttgtttatcacattgataacacaaatgacggtgtgcaaaatttaacggtttttgacaatggacacagctaaaattaaaccagttcacttaagttataacctccagagtggaaaaaagtgcagtattccattcaggaaaatatagatcaaaagattagggataatttctcgatcttaatcacaaaaatgctagaattagccaggctaaactaatcattttatgaaggaaaatttatgtctttaactgactatcgtgaaaaaattagcatggtattttttgatattgacgaaaccttattttcaaaagaaaaagatcatttaccagcaagcacttattttgcattaaaatctttgcgtgaaaaaggtgttttggtaggtattgcgacagggcgtgcacgctgtacttttcctgccaaaatcaatcaaatgattgatgaattagggattgatatttttgttactgccaatgggcaacatgttgagtatcaggggcggacattagctcgttatgcaattgacaaaaataaattgtacaaactggttgagttttttgatcaatatggcattgattatgttcaagtagcgaacaccgagattaaaatttccagcctcaatccaatactcactgatgcttttaatccaattagtacgaattatcaagtagatcctcgttattttgaacggcatgatgtattacaaattttgtcattctatgaggataaaagctacgatgaattaattgctcaatctaatattttagaagggttaaaaacagtgcgttggcatcctaattcagtggatatatttgataaagacggttcaaaagcacggggaatccaagttgttgttgagcatttagggttgaatatggaaaatgtgatggcatttggtgatgggcttaatgacatagaaatgctaagtgcggtcggtgttggcgttgctatgggaaatggtcatgaattgttaaaacaacaagcgaattatgttactgatcacattgaagaaaatggcatttataattttttacataaagttggtttggtgtaattttaacaaggttaaataacttataggtcgctttttattttctcggcatcattatcctcagtaagaattcaccgcacttttctattagctatgataaacttattgcccttttaggttgatgatgagtgtttatgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcaagatcttcttgatgtacttaatcagggcaaagaggtgcaatttaatttgcaattgattgaagggcaacgttttaaaacttggcgtaaaattttagaaaatgcaccgcacttgcggcaaacattacaaggaaaatcggagaaagagatttttactttgctggagttgccggcttattcaaaagctgtttatgaatggaaaacgattgatggttggttatatccggatacttatagttacacgcctaactctagcgatttggcactgttaaaacgtgcggcttcccgtaccataaaagcgttagagcgagcttggcaacaaagaaatgtaaatttgccattgaaaaatccctatgaaatgttaattcttgcttctattgtggaaaaggaaacagcattgagtgaggagagagcgaaagtagcgggcgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatagtgaaataaaatgaaaacaggaaagtttattgttattgaaggcttagaaggtgcaggtaaaagtagtacacatcaagttgtggtaaatacattgacggagtttggtattcatgaagttgtttttacccgagagccgggcggtacgcctttagcggaaaaattacgttatcttattaaacatgaagccgaggaacttgtcacggctaaagcagaattgctcatgttgtatgctgctcgagttcagctcgtagagaatgttataaagccggctttagcaagaggcaaatgggtagtgggagatcgtcatgatttatcttcacaggcttatcaaggaggcggtcgaggtttggatcggcatttgatgacaacgttaaaaaatgctgtgttgggcgattttaagcccgattttacgttgtatcttgatattgaaccagaaattggtttagcaagagcaaaaggaagaggggaattagatcgtattgaacaacaaaatttagatttttttcaccgcactcgagagagatatttacagttggttcagcaagatcctaatgcagtgctaattaatgcggggcaacctattgagcttgtgcagcaagatattcgtaaagctgtgcaaaaatttattgaagaaaatgtgtaatttatatccttggttacaaccttattatcaacaaattatccaaccttttttacaagagaaagggcatcatgctttgttatttaaagctgaacaaggaataggtatcgagcaattgattgaaaatatcgcaggttggttaatgtgccggaaaaaagatgccccacaatcttgccgacaatgccaaagttgtgcattattcagagcaggaaatcatcctgatttttatcgacttgaatctcttgacaataaggatattggtgtcgagcaagtgcgagaaatgaatgaaaaagttagtcagtttgcaaaacaaggcggaaataaagttgtgtttattcgtcaagctgaacgtttaactgaaagtgcggcgaatgcgttactaaaaacgttggaagagcctagaccgcatacttattttttattacaaatggacttttcggctgggttgttagcgacaatttatagtcgttgtcaagcttgggttattaatacgccaacagagcaacaaggtcttgtatggttgcaacagcagcgtcaggaaaaaatcgcagatttacaaaccgcacttcgtattaattataatcgtccattgctggcattggattgtttggaaaaggggttattggaacaacgaacgacatttttacgtcagttttggttgttttatattcgacgttctcccttggagttattaccgcactttacgaaagaaaatgttttattacaactggactggatgagtgcatttttacatgatgcactcaaagaaaaattaggtgttcggcaaggttggatcagccaagatttagctcgtggcattttgcaatttaatgaaaagcaaaatgtggaagagttgttaaaagcaattcaaattatccaaaaaatgcgtttgaatctaacgcaaatcaatggggttaaccaagagttaattttattagagggattgactcgtttggtaaccgatgtatttgaaaggaaagaataggaaaagaaatgtttattgtggatagtcattgtcatcttgatgccttggattatgaaaacttacatacagatattgccgatgtggtggataaagcaaaacagcgtgatgttaaacatttattggcagtaggggtaactttgaagcgttttgagcaggcttatgcacaattagccttatttaaggaagtttccctcgcttgtggtgttcatcctttggatttggcggaagaaccttttgattatcagcgtttattgaggttggcacaagatgaaaaggtagttgcgataggcgaaaccggattggattattattacagcattgaaaataaagctttgcagcaatctgtttttgcacaacaaatagagattgcaaatcaactgagtaagcccgtgattgtacacactcgatccgcccgagacgataccattgccattttgcgagaaaataatgcacaaaagtgcggtggtgttttacattgttttacagaaaattggggaatggcaaaacaagcacttgatttagggttttatatttcgatttcaggtattattacctttaaaaatgcacaagagttacgtgatgtagtacgtcaagtaccattagagagtttgttagtggaaactgatagcccttatttagcaccagtcccgtatcgaggtaaacaaaatcagccggcttatacacgtgaagtttgtgaatatgttgcaacattgaagggattatcagcggaagactttgcacaaattactacgcaaaattttgagcgtttatttaagattaatgtacaataaagcaacgatttacagggggagttatttatgagaaaaatatttaaaaaggtagtgttggggttactattcttattccatgtttttttattttctgtggtgcattatgttacgccacattatgatgttaccaaagttaccggtgtagaagttaagagagttgataaagatggacctattactaaagctaatccggctgacggtccgactcgtgatgtgtattatatttacacgcaaaaaccgaatgaggaaaacgtgatggtgtatcgtaatgaagatacacgttggagttttccattttattttaaattcggttccgccgatttacaggcaaaagcccaaagtttttcagtggatcataagttagtggaaattaagtattatggttggcgtttggttatgtttgatgaattccgtaatgcagtgtcagtcaaagaggtgagtgcggatacagaagcttctcattccattttagcttatgttttttacgcatttttattgattacgttatttttctctatccaatttgtgcgtggttggtttgatagtgaagactaactttttggtttgatatgcttctattctcatcagaagctactttgttaggcattgaatattatgagtttattacaggcaatattagtcattattggcttaattattattagtgcggtcgtttcttccgctgaaatttcgttagccggttcacgtaaattgaaattgcaaatgttagcgaatgagggtgataaacgagctgtgcaagtattaaaattacaagagcaaccgggacgctttatcacagttgtccaaattggactaaacatggtggcaatttttggagggattgtgggtgaaagtgccattcgcccttttttacaggagattttaagtgcttatacgcaatctttttgggtagaaagtgcggcttcttggctggcttttattattgtcactgtttcttttgttctcttcgctgatttaatgcccaaacgtttagcgatgacaagtccggaaaaagtagcattgtcaacagtaggaataatgtctttttgcattgttatttttaaaccagtggtcttaatttttgatactattgcgaacggaatttttcgcttattgggaatttctaccatgcgggaagagagtatgacgccagcggatattgttgcaattgtagatgccggtgctgaagcaggcgtattaaaagcacaagagcattatctgattgaaaatatttttgaaatgcaagagcgtacagttacgtcaactatgacgactcgtgaaaatattgtgtttttagaccgctcttttgagcgtgagcaagtcatcaccacaattaaaaataatccacattcaaaactacttatttgtgatcacggtttagataaaattttgggttatgtggaaagtcataatttattaaccttatatttgcaggagcaaaaagtttctttaaccgaacctagaattttacggaaagcattatttattcctgatacgctttccctatatgaagtattggagttgttcaagtcttctggtgaagattttgctgttattgtaaatgaatatgctctcgtagtggggattgtaactttaaatgatgtaatgagtattgtaatgggcgaattagtttctaatgaggaagaacaaattgttcgccgtgatgaaacatcttggttgattgatggtgcaactcccttagaggatgtagcacgggcattggaaattaatgagtttccggatgaagaaaattacgaaaccatagggggatttatgatgtatatgctacgtaaaattccgaaaaagacagatttcgtattatatgatagatataaatttgagattattgataccgagaattttaagattgatcaattgatggtatcgctaagaaaggatatttagacaagattcaaaagagagtaaaccacatcttcgctttctttagatattatcagtcaaatgcaattaatgggatttttcttataaaaatagaaggttatgtaaaagagataaaaagcaatccgaagattgcttttttgttccgcttattgagcaagtgcacgttttaattttaggatagtcgccttccctttatcttcatcgacttgtttaagattggctccgccaacaaatgcaccgggtttaatatattggcgaataaaataattttttccgccatctgtcgtaatatcaaggtgattatcactaaactctgattctgttgagagcctatgattacctgggattacacgcttgtaaaaatatgttttgggtgcggattcaccaataagtttgccatcgatataaagattcttcttcaacgcagctccaaatattgaatcacgataaatataaatccctgattcatcctttgatggaagcaaaaactgtttagccaaagcatcattttcaggggtatccatcaccgttctggcacaaccggtaagtcccaaagtgattgccagcaagagagttgaaaaaattttcatttgatgcctagcccatacgacttagaagtaataacttgcactcaatgacaagctttgtggtttgaagcgaatatcgccctttatattgcggaggaagactttttgatattcaacacccacatcaaatttatccgttacggcatattttacccctacagcagcaccaataccgacaacagagtttccttttatggtgcaactatcacaaattttcttggcattaagatcataaaaatgactatttaaactcactttaagatacggcatgaaattgttactaatgcgatagccttgaagatagccaacactgaaagaaaatttttctttggatagtagttcgttattagaagtgatttttgaaccgccggtacgtaattttacttctgcctgacctacaaaattactgtcaccaaaattaaagccgtaaccaccgaataaaccaaagcctattttgcctgattttttttgggtttcgctttttgctgtttgagaaagcgtaccctcataaccatgttttgaatgatgaacttctccacccataaaaaagccagtgaaagtatcttgtgccattgcaccacttgccatgcaagataataataccgttgcagcgatagatatttttttcataaataaaccctcttaataaagattaagttaaatttgaaactattttattgttaagagaaaactaagtcctaagatcttaattttcaaagatatattctacataggtatattatgagtaccatagacaaataagacattattagtctaataagtagaaaaacagtctaaaaagaggaaatgaaaaaattatctacatattgtctgaaagtatttaaacgaaaagagcggtgtaaattttaaaaattcgtaccgctctttttctatatcagttacttaaaaagaatattcatatttctgcgatgttgcagtcggtattttctattaagaattataatttaggctcaccaattggtaatatggttttaccaaaactttcattgataatatcagcagcagcgagatagaacgctaaaagtgcggtcaataaaccaaagtttccacctagttggctaaagttgtgattaccagtaaaatcgcctgcggcaagtaagtagaaggtgatggttaacgctaagaaaatagcctgtaatgcacgagtttttgctaatgtgccgataaacatcatcaatgtgaatgttccccacgccgctaagtaccagcctacaaaagatgatgtgacaccttgtgagaaaaatactttgaataaggcaaaactccaccaaaaggcaccatagctggtaaatgcagtaaaaccgaaagtattaccttttttgtattcaaacataccggcgatcatttgggctgtaccaccaaacgcaaatcccatggctagtactaaacctaaattttcaccgctgaacataccgttattgattaaacttaataaccaagttgttaatgcaaacccacataagcccaatggtgccggattcgctaagttatcttttgttgtcgacattatattttgcccttaaattaatttgataaataaaaaaggcgttattatctatgattttattgaataaataaagattggcatgaaaaacgctaggataagaacaatgaaattgggaaagtagctagaaaattaattattttttgtttttcgctattgttatttagatgtaaaatacgttcacctgagttttaagggtaaaatacgatgagcgtttagtcgccacttagtctgcaaaatgcgaaatgttaaatcacaagcatgtgagtttaaggattggcaagaaatgttatcatcaagttaaacgtcagtttctcgtttttacgcctaaagttgctggagcacatcattggacacaggtaagctcgacattagaggggagttagaataaaatggatttcgttttctaacagaagaaagtaattgtttttaaaaggaaaatttgttgaatactcaatctaagcaaaacgctagttttgtttttattttaaccttaggcattttatcaatgttacctccacttggagtggatatgtatttgccggcatttttaaatattgcacaagatttgaaagtaagcccagagcaagtgcaacatactttgactttttttacttatggtttggcggcggggcaattattttggggacctgtgggagatagttacggacgtaaaccggttattttattaggtgtgattgttgcgactattacagcatttattttaaccggcattaataatattcaaaatttcaccgcacttcgttttattcaaggcttttttggtgcggcacctgtggttttatccggtgcactattacgagatttgtttagcaaaaatgagctttctcgaatgctatcgatgattactttagtgtttatgattgctccattactcgctccaattattggcggtaatttgatgcgttttttccattggcatgcaattttttatgttatctcggcaatgggaatgctaagtgcggtattggttttttatgttattccggaaactcataaaaaagaaaatcgcattcctctcagattgaatattatcgcacgtaactttttttctctgtggaaacagaaagaagtactgggttatatgtttatgtctgcttttggttttggcgggttatttgcttttgtgacagcaggttcaatcgtttatatcggactttatggtatagccgttgaaaattttggttatttctttatgttaaatattggggttatgattattgcctcctttatgaatgggcgattggtgtttaaagtgggtgctgaacgtatgctacaggttggtttgatggtgcaatttatcgccggtctttggttagcattcgttgcgttttttgatttaggtttttggtctatggcaattggtgttgctttttttgtagggcaaaatccattaatcagttcgaatgctatgacatctattttagagaaatttccaactatggcaggaacatcaaattctatggttggaagtgtgcgtttcggtatgggggcaattgtggggacaattgttgctttatttgaaatgaaaacggcagcaccaatgcttttaacaatgacgatttgttctttgcttgcggtaagttgctattattttttaacttaccgtcatttaaaaaaataaaggaagatcatggcattgcaaccttgccctgagtgtcggcgtaaaatcagtgagtgtgcgataagttgtccacattgcggtttttcgttacaagaagaaaatttgatgctatatcgtgaaaaactaaaaaaacattgtcagtataatcaggagattaaccgagcaagtattaaaatccatttattttggttggcggtgttttctatagtgatcgggattgtcggttggttaagtaattagtcgttaaaagatattcaagcccctgtaataaggggcttttttgtatggtttaactttttgttttcattgctggaaataaaattacatcacgaattgagttagcgttggcaaataacatcgctagacgatcaattcctaaaccctcaccagccgttggtggcaatccatgctcaagtgcggtaacaaaatcttcatctttaaacatagcttcatcgtcaccagcttcttttgctgcaacctgtgcatcaaaacgctcattttgatcttctgcatcatttaattctgagaaaccgttaccgatctcacgtcctccgataaataattcaaagcggtctgttacgtcaggattttcatcattgcggcgtgctaaaggggagatttctgccggatgagccattaagaaagttggttgaattaaatgatgttcagcaacttcttcaaaaattgcattgactaagctacctagcccccatgatttttgtacttcgatacccaatttttgtgctactgcaacagcacgatcgaaatcgtataaatcttctttcacaataccttgctcggcaccgtattttaagattgcctcgtgcatggtaatacgttcaaacggtttgccgaaatcgaattttaaatcgccgtaaggaacaatggtcgtacctaaaatatccagtgctaatttgcgtaaaagttcttctgtattgtccattaaatcgtggtaatccgcataggcttggtagtattccaacatagtaaattcagggttatggcgaatagaaacaccttcattgcggaagttacgatttaactcgaatacacgttcaaaaccgccaactaccaaacgttttaaataaagttcaggtgcaatacgtaaatacatatccacatctaacgcattgtgatgagtaataaatggacgtgcagatgcaccacccggaataatttgtaacataggggtttctacttccataaatcccttggaaatgaaatattcacgaatgcctgcgattactttagatcgaataataaaagtgcggcgtgaatcttcattagcaattaaatctaagtagcgttgacggtaacgagtttcttgatcgctcagtccatgaaatttattaggaagcgggcgtaatgctttagttaataagtgaacttccgttgcacgtattgtcaactcattggttttagttttaaataaagtaccttttacaccaacaatatcccctaaatcccaattgcccacatcatcagtataaacaccttcagctaggttatcacgagcaacataaagttgaatttttccgctcatgtcttgcaatgtgataaaggttgctttacccatgacacgacgagtcataatacgccccgccacttttacttcaattccctgtgtttttaagctctcactttcaatttcatcatattgtgtatgtaagtcctgtgctaaagcattgcgacggaatgtatttggaaaggcgttgccttttgctcttaacgcagctaatttttcacgacgaaccaacatttcgccattgagatccaattcttgaattatttctgtcattatgtactcctcttggaaagtcacttgtagaataaatttgtcatttgaataaaatattgtggtttttgaccgctctttatagtccggcttttaagctggcttcaataaaacgatccaaatcgccgtccaatacagcttgagtattgcgattttcaacacctgttcgcaaatctttaatacgggaatcatccagcacataggagcggatttgactaccccagccgatatcagatttactgtcttccatggcttgtttatcagcattttttttcatcatttccatttcgtacagttttgcttttagctgcttcatggcttgatctttattctgatgttgagatcgtccattttggcattgcaccacaataccgctaggaatatgagtaatacgcaccgcactttctgttttattaacgtgttgtccgccggcgcctgatgcacgataaacatcaatacgtaaatctgcaggattgatttctatttcaatatcatcatcaatttcaggataaacgaaggcagctgcgaaagaagtatggcgacgattattggaatcaaatggacttttacgtactaaccggtgaatacctgtttctgttcttaaccaaccgaaagcgtattcgcctgcaatacgaatagtggcagatttcaagcctgcaacatcgccactggaaacttcaactaattcggttttaaagcccttgctttctgcccaacgtaaatacatacgcaatagcatttctgtccaatcctgagcttctgttccgccggagcctgcttgtaggtcaacataacaatcacagttatcatgttgtccgctgaacatacgacggaactcaagggtggcaagttttttttccaattcttccgcttctgcgacagcttcattaaacgttgtttcatcttccgcttctacagaaagttccagtaagccatcgacatcttccaaaccttgctcaagggtttttattgtattaacaacaagctctaaattagcccgctctttgcctagcgattgagctttttccggttcattccaaatatccggttgttcaagttctgcatttacttcttctaaacgttcaacttttgtatcaaagtcaaagataccccctaagcatatttgtacgctcagtgagatcgattaatttattttttatcggattaatttcaaacatagcttttcccaatgataacaagtgctgaattataagctattttgctgatgttgggtagttgcagattagattgttcaaaggatttatgttagaatttcgtccgttttttactgaaaattaggaacttaaaatgaaaaaatttttaatggtaagtttagccatgttgatgtcaacttttgtaaaggcagataataatgtcacaattcgcaaaaatttacaaaaattaggtatgactgatgtagaaattatggagtctcccattaaaaatataaagagtgttttgacccgtgaaggtactctgtatgtttcggaagatggtaaatatgttttacatggtgctttgtatgaaattactgacaaaggtattgtgaatttaacgacaaagtctttattggtaaaactgaataacttaaaaaatgagatgatagtttatccagcgaagaaggaaaaatatgttattaccgtattcatggacattacttgtcattattgtcatttattacatcaaaaaattaaagaatataatgagttaggtattactgttcgttatttagcttttccacgtgccggtctaaatagcaatacagcaaaacaaatggaggcgatttggatatctcgagatcctgttttcgctttagatgaagcagaaaagggcaatttaccgaaagagctgaaaattccaaatatgattcagaaacattatgagcttggtattcaatttggagttagtggcacaccaagtattataactgaaagcggcgaagtgattggcggttatgtagagcctaaaaaattattgcaagtattagaagatattcgtgaataagtttattaaacgacgtgatgttgcgatagatgttcaagtttgtgaacatcctttattggaccgaatttaccgtgcacgtcaaattaaaaatcctcaacaattagaccgcactttgaaatctatgttggcacctgatttgctacatggtattggaagtgcggtggatttattggtaacagcgagagaaaaacaacaaaagattgttattgtcggtgattttgatgttgacggagcaaccagcacagcacttattgttttggctctgcgtcaacttgggttcacagatgtagattatttagtacctaatcgctttgagcaaggttacggtttaagcgtggaagtagctaaattagcattagaaaaaaatgttgagttattgattacagtagataatggggtatcttcttttgatggtgttgtgtttttaaaaaatgcgggagtgcaagtgttgattacagatcaccacttaccgccggaaatattgcctcctgcccatgctattgttaatccaaatcttacacaatgtaattttccttcaaaatttcttgctggtgtcggtgtcgctttttatgtcatgctggcattgcgtgcaaaattacgtgatttagggatttttactacgcaaacccaaccgaattttacagagttattagatttagttgcccttggtacaatttccgatgtagtaccgcttgatcaaaataatcgtattttagcttatcaaggtttagccagaattcgagctgagcgttgtcgtcccggtattcgtgctttggcggaaattgcaaatcgtaatatgagtcgattgaccgcttccgatttaggcttttctattggtccaagattgaatgctgccgggcgtttggacaatatgtctgttggtgtggagttattattgaccgatgatatgcaacatgctcgtcaattagcttttgaattagatagtttgaatcaggctcgtaaagaaattgagcaaggtatgaaacaggaagcgttagaaatttgtcggaatttgaccgcactttctaagcaattaccgctgggcatcgtactatatcaggttgattggcatcaaggtgtactcggtattttggcttctcgaattaaagataaatttcatcgaccgaccattgcgtttgctcaggatcaagtcggaattttaaaaggttcagcacgatctattgaaggtttacatatgcgtgatgtgttagagcgtattcattctcgctatccggatatgattttaaaatttggtggtcatgcgatggctgcagggttgagtattcgtgaggaattgtttacacaatttcaacaagcctttattcaaactgtgactgaatggttaaaagaagaacaattacaaggtattatttggactgatggtcaattagcaccagcgtttttaaatttggaaacagcggaattactgcgtcaagccggtccttgggggcaaggttttccggagccgtgttttgatggtgaatttacaattttacgccagagtattgtgggtgaaaaacatttaaaaatgcttgttgagcctaaacaaggaggtccgctgttggatgctattgcatttaatattgataaggattactaccctgatttttcgataaaacatgcaagaatagcttataaattagatagtaatgagtttcgtggaaatcgtcatgttcagttgttggtagattatattgaacctttagatcattaaatttatttttcggcactggtacataataatgttttagggacaataaaaatgacagaagaatatggcgtatttacttatccctatgtcattattaatggtaaatatgttttgacagcaagtactttatataacgatgattatagtgttgcagtgcttgattttttaattcatcaaattcaagtggagagcaggaaatgaaagtaggtattgttggtgcgatggcacaagaagttgagattttagcgagtttaattgagaataaaaacgtagttcatattgccggctgtacaatttatcaaggaaacattcaagataaggaggttgccttattacaatctggtattggaaaagttgcagcggcaatgggaactacactattattgcaaatgtttaagcctgatattgttattaatacaggatctgccggcggcgtatcctccggattaaaagtgggtgatgttgttgtgtctactcaaactgtttatcatgatgctgatgtgacagcctttggctatgctaaaggtcaactgcctgcttgtccgcccgcttttatttctgatccgaaactgaccgcacttgttgaaaatgttgcggagcaacaaggaattaatctgacttccggtttaatttgctccggtgacagttttattaatagtgcagaaaaattagcttggataaaagcaaattttccagaagttgttgctattgaaatggaggcaacagctattgctcaggtatgtcataaattcaatattccgtttgttgtcatacgggcgatttctgatgtcggagacggtgaagcaagcatatcttttgaagagtttttgcctttagcggctagacagtcttcctctatggttctaaagatattacaaagtttgtagggaattgatttattataaatatcaacttgataaataaagaaaaaatctccaaattgatctgcacccaaaaagttggactaaacagccaactgattaaggtgcagattttttatgactaaatataaccaatctttcaaacaacaagtcatcaaattttatcttcaaaacgggaaaaatcgctcgcttactcgtcagcattttcagctagagaaaagtacattacgtcattagattaaccaatatcatcactatgggttcaaaaggttagctgttttaggtaaacagcaaatgttgtaaaggcactgcgagagcaatttccgcttgaaatcctgttgccacttatcgacttaaaacgtagtactttcttttatcaccttgcagataaagtggataaaaatgcggaaattaagcagaaagaggccgagatttatcacgaaaacaacggtaactatggctatcgtcgtatcacgctgatattgagaaaaatctgaacaatcaaccataaaaaagtccaagcaacagaatgttacttcggcaagcgtttgacacgcttggcgaacttaagcaaaccattcatgaatacattcattactacaacaatgagcgtattcaagtgaaattaaaaggaccaagtcctgcagaatacagaactcagtcctcaagttaacgcagtctaacttttttgggtcagattaattcggagattttttgttttggattattttgagcttggaatgctgaaacgcttgttgaaacgttctacacgaccgccggtatcaacaacacgttgtttaccagtatagaaaggatggcagttgctacatacgtccaagttcaaatttttacccactgttgaacgagttttaattacgttaccgcaagaacacgtcgcagtaatttctttatattcagggtgaataccttgtttcatagaaaacctcttaaaaatcactccgctctccaaaaccgaatttggcaccgagtgctgttaatattacgccatctaaaggcaatttagtaagatggcagattataccgaaaaaatgggctttttcaagttatctgtataaaaaaccgcactttatccttgcatgttaaagtgcggtataatttgcaacaattttttacattgctgtccaaagtaaaatggcaagcaactgaggcgacataatacgcaggaacatagaaagcggataaacagtagcgtaagataatgcagctataccgctatcttctttaattgcattggcaaaagccagtgcgggaggatcagtcattgaacctgcaagcaaaccgcataagctgagatagtttaatttcatgtataagcgagcaataatgccggtgatcattaatggaataaaggtaatgaacataccatatcccatccattcaagtccttgaccattaaccagtgtgtcaacaaatccgcctccggattttagtccaacaacagctaggaataaaacgataccaatttcacgtagtgctaagtttgcactgggtggcataaaccaatagagtttaccgacactaccaatacgagcaaggattagtgcgacaactaatggacctccggctaaacctaattttaatgctacagggaatcctggaatgtagaatggaattgagcctaatagcacgcctaatccaattccgataaataccggtaacatttgcacttgttgtagtttttgttgtgcattgccaataattgaggttgcattaccaattgtatcggatcgccctacaatatgtagcacatcgccaaattgtaatgcggtgttggctgttggaactaactctacgccggcacgatttaaacgtgaaatcacaacgccatattttttatgaattcctaggtgttttatgcgtttaccaagcactttttcattggtaacaacaatacgttcagagcgaagatctcctgctaaatgagtcataggcatatcaatttcctcacctatcaccaatttcatttttttcaaggcattgatttcaccaactaaatgtaatacgtcatcaattgctattatggtatctgcacttggtacactaatattttcttgtcgttttaaacgagaacaaaccacatctttattgtcaaagccgggaatatcaattaatcgtaaaccacttaaatttggattggtcactttaacatttactgttgttaagctttctttatcctgtccgctggctttttggaattgtttctcttcttcttcaaccttaattttaaaaaataaacgaattaaccacatgctaagtaaaatgccgcaaatcccgaaaggataagccatagcgtacgccatacccattgtgctgttagcattttctatgcctagttcagtgagaatttgttgacccgcacccaaggatggcgtattagtgaccgcaccggagtagataccgagaataatatcaagatcaacattaacaactttatataggacaaaaacacttactgcaccgagaacaacaattaatgttgctaagccgttaagttttaaaccagcagaaagtagagaggcgaaaaatcccggaccgacttgaatgccaatggtataaacaaatagaattaacccaaattcttggataaagtgtagagtgtgtgcatctaatttcaatccattttggttcataaaatgagcgacaataatcccaccgaataatactcccccgatgcctaaaccgactccgcgtattttccaatgccctatccataaaccaataacggcaacaagggctaggatacaaattgtgatagcaatatcactcataccgacctcttttaaagttaaatataaaaaatagctactcgaattatatcaagctcaattcaaagaaacgataaaaatctaaaaaatgtaggatttatcacatttttcttgattaagttatggtttttattaacaatatttgaaaaaaattaaatttcatttaatccctttattataagaggcgttgagaatacaaaatgaattggacggaagaactttttacatcgttactttggatagtgaaaagcttatttatagcaagcttggttttctctttaattttatattttttgataaaaatgacccgatggggacatcaattttggctattagcgaaaagttatttatcaccacgtcatagccttatgcctttgtgttatttttgggtaatcgttttttttgacttattatccgtgcgtttggacattttattttccagttggtacaagtccatgtatgatgccttacaagaaatgaacgtagttggattctagcagcaaatggttgttttttcccttttggctatggttcatatatttaatgttttgcttacttactatatttctcaggatttcaaaattaagtggagaacttggcttaataatgaaatgttagataaatggtctgaaaatcaggcttactataaaacccagtgccttgctcatcaattggataatccggatcaacgtattcaacaagatgttgatgcctatgtttctaattcattaaactttgctacaggtgttatttcttctacagtgtctttagctgcatttaccgtgattttatggaatttgtcaggtccgatggtaattatgggctatgaaattccacatatgatggtattcttggtttttatttatgtattagtgagtagtgtaattgcttttagaattgggcggccattgattcaattgaattttgttaatgagcgtttaaatgcaaactatcgttattcattaattcgtttaaaagaatacgcagaaagcatagctttttatcgaggggaaaatatagaaaaatcgatgttattacgccaatttgaaaaagtaattggtaatttgtggcaaataattcaccgcactttgaaattatctggcttcaatttagtggtttcacaggtatcagtcatttttccatttattattcaggcagcccgttatttttccggacagattaaattaggtgatttaattcagacgtcacaggcttttagcaaggttcagtcagcattatcgttttatcgaaactcctatgatgattttgctgcctatcgagcggttctggatcgtctaacaggtttccatagtgctattgaagcagctaatcagccatcaaaaacacaaattaaacctcatatgtcagcggttatttttgagaatttaaatattaatacaccggaaggaaatactctcattgagaagctgaacttaacaattgagcaaggggtttctttattgattaaaggtaaatcgggtgtagggaaaacaactttattgcgtacaacagcaggtttatggccgtattcagaagggcagattttttgtccacaacaaacattgtttctagcacaaaaaacctatttaccacaggggtgcttaattgatgctctttattatcctgaaccggttccggccgacattgacgcagacaatatcagtaacattttgcaaaaagtgcatttgtctcatctggttgacaaattggatgtagaaaatgattggacgagagtactatctttaggggaacagcaacgtgtagcttgtgccagagtattgttgcataagcctaaagttgttttcttagatgaggctacatcaagcatggatgaagggcttgaagatgcgatgtatcgcttattattaactgaattacctagtacaactttaatcagcgtgggacatcgttcaactttgcataagtatcatcaattacacttgcagatcaatagtgataaaagttgggacatgatgaaacatacagaaacattttagcgtaaaacatatttgttaatttgctgaatgaaatgtatccattgatgttaagtcgatggatttttttacgttctaaatttgacatagatcaaataaactttatttttatttgcaaagcattctcaataaaaatgagtttttttactagaaaaatgaatgattaagcaggtttttcttacaaaatttatgcaaataacacacaatatatagtggttgagtttttaaaagtaacaatatatagtgatttgacttttcttaaacgcaacatataggtttatgtaaaaatgggttcattcttcgttattaaacgtgatggttcacgtgcagaatttgaaatacaaagaattattaatgctattaaaaaagctgcaagtgcggtcaatatccaagatgaaatgttctgtcataaaattggacaactggtctgtgataatatttttgctcattaccaaaaagaaattgatattagccacatccaggagattgttgaaaatcatctgatggctagcaagtatccacaagttgcacgagcttatattgaatatcgtcatgagcgtgatttagctagagagaaacgtagtaatttgactaaagaaatcgaaggattaattgggcaaagtaatgtggaattgttaaatgagaatgccaataaagattcgaaagtcattccaactcagcgtgatttattggcgggtattgtcgctaaacattatgctaaacgttatattctgccaaaagatgtcgttgattcccatgaaaaaggcgaaattcattatcatgatttagattatgcaccattctttcctatgtttaactgcatgctggtcgatttaaaaggtatgctgacgaaaggatttaaaatggggaatgcggacattgagccgccaaaatctattggtactgcgactgcggttaccgcacaaattatcgctcaagtagcaagtcatatttatgggggcaccacggttaatcgtattgatgaagtacttgcaccttatgtgcaactcagctatgaaaaacacttgaaaacagctgcactttggcaaattccagatcccaaagcttatgccgacagtttaattcaaaaagaatgttttgatgcttttcaatcgttggaatatgaagtcaacactctgcatactgccaatggacaaacgccatttgttacttttgggttcggtttggggatcagttggcaagagcggttgattcagaaagctattttgcaaaaccgaattcgtggattggggaaaaatcataaaacacctgtttttcctaagttggtttttacaattaaaaaaggggtcaatcaaaattcaggagatccgaattatgatattaaacagctcgctttagaatgtgcttcaaaacgcatgtatccggatattctcaattatgatcaagttgtgaaagtaacaggttcatttaaagcaccaatgggatgccgtagttttcttggtgcttatgaagaaaataacgaattggtccatgatggacggaataatttgggtgtagttagcctaaatttgccacgtattgcactggaagcgaaaggagatgaacagcaattctatacattgcttgaagcaaggttggatcttgctaaaaaagcattgatgacacgtattgcccgtttggaaaatacaaaagcacgagttgcaccaattttatatatggagggggcttgtggtgttcgtttaaaagcagatgataatgtggcacaaattttcaaaaacggtagagcatcaatttcgcttggttatattggtattcatgaaactattaacgccctatttggcggtaaacacatttatgatgatacaaaattgcgtaaaaagggcattgaaattgtcagtttcttgagcgaaaaagttaaacattggaaagcggaaactggctatgcttttagtttatattccacaccgagcgaaaacttgtgtgatcgtttttgtcgtttagataccaaacagtttggtgttgttgatggagtgacggacaaaggttattacacaaatagctatcatttagatgttgagaaaaaagtaaatccttatgataaattggattttgagatgccttaccctcgtttagcgagcggtggatttatttgctatggtgaatatccaaatattcagcataatttaaaagcacttgaagatgtttgggactattcttatgaacgagttccttattatggtactaatacaccgattgatgaatgctatgaatgtggttttacaggagagtttagttgtacaagcaaaggatttacttgccctaagtgcggtaatcatgatagtgaaaaagtctctgtaacccgtcgagtatgcggttatttaggaagcccggatgcacgtccgtttaatgctggaaaacaagaagaggttaaacgccgtgttaaacatttataaaaatcatcactctttatgaattatctgcaatattatccgattgatgttgtaaatggcgaaggcacaagatgtactttgtttgtcagtggttgctcccatgcttgcaaagggtgttacaaccaaaagagttggtcatttagggctggagtattatttgatcgagagatggaagatcaaattattcgagatctacaggatagacgcattcgtcgacaaggattgagtttaacaggcggtgatcctttacatcctcaaaatattaccgcacttttgccttttgtgcagagagtaaaaaaggaatgtcctgataaagatatttggctatggacaggttatttattagcggagcttgatgaattgcaacggaaaatgttgccttacattgatgtgttaattgatggtaagtttgagcaagaaaaagccgatccaagtttgatttggcgaggatccgccaatcaagtaatttatcgttttaagctttagcttttacacaagtccttgcataagcatactcatacgaatggtgcggtatatttaaactctatattgaatttgtataaccaacgtcaatttagatcgttattacgatatagaatatatcagcaaatcgaatattataaaaaaaccgctcctaaagagcggtttttttgcgaaggttttaaatcgggtagccaagttgtattactacaacttagccccctaagaactgtacaagcaaatttctctgcatacagctcaagcctttctattaactgctacgcagtcggtttcgcaacgttcaaattcaggcgatgaatttgttggtgacactcaggatgtactaaacatctgttatttagtgaatctgttccaccatacattttgtaaattatatgatgatcgtgccagccgctttctttcgttattgacgtattacacaatgcacattttcctttctgctctttgtaaagagcttgccattgctgtctgtgtgattgttcatcatacattctggcttgagcaaggttttctccatacatttcccattcaggtaaaaatggtttgtattgtgattttatctttctgtgtcgcttaattttcacatatccacaatagagtaaatttattgggatttgttcttctttattgctgttggtgactgtgccgaaaatccaattccgagttgcatttgaataaaagtatttctctttaatccaaatttttcctttgtttggatgtcttcgtctgcaccaacgccataaggctttccaaattaaactatccattcggttaaatatcactttagccacaacgtgtttatgatagtttgtccaacctcttatcattggatttaatacttttattaggtcatcttgtttcgccattttcatttttgaaattgattgttttaccttgtcgtaaaatgcttttgcatttttcttacttggtttaataatcaattttttatcaaaacgtttaacagtccaacctaaaaagtcaaatccgtgttcgatatgcactaccttggttttactttccgataaggaaagccctctttctgcaagaaagtttttcaccatagggataacttgttcttccagtaattcttttgatatacctgaaataataaagtcatctgcatacctaacgaggtatgtccgatgttttgctattttaagactattctttgcaccaaagtgcttgattagctctttttctaacccatctaacgccatatttgccaacgttggagagataatatcaccttgcggtgtcccctccgttgttggttttagttgaccgaactcaacaacacctgattttaaccatttcttgagtattcgcttattcattggaatatgcttgagtagccagtcgtggttaataaaatcaaaacaaccatgtatatctgcatccagtacccattctgccatttgacgagattggtttccttttgttgaaaatatactatgtatatgtgatatagcatctgccgttgaacggtttaatctaaatccatacgaattattgtctgctgttgtttctgctatgggttgcaatgctagtaaatacaacatttgcattgctctatctttcatcgtgggtatgcctaatggacgtttcttcccatttgactttggaatgaaaacccgtcttaatggtttaggttgataccctttacttgatagatcttgtatagcaatccatttggattcaggtgtatcccaaatccgtttatcaataccagcggttcgtttgcctgtattttccgtcacccgtcgtactgctaatgcttttgcataaaacgagtgggtaagcattcgttgtaagtttttaaccttacgccaattgctttcctgtgttgccttcgcaatccgcacctgcattcctttcacatatcggtttgctttataccaattgatataatgccattgcgatatatgtgaggtcgctggagctagactgcttactaatttcttagtatgatgagtttgctctttcatacttacctccgttgagagataagttttcttggtaaattaatcgttcctctttctgtttggacacttcaagagttgctatggttaccaataaacttacactcttgaatcactaaggataaagagtgcgtgcgttggttttatttgattggttttcaatctgcaagccaacgctcgcttttatcccgtcaaattttaaaggaatttgtcagacatcttgcgatgaaagaccggttagaagtctgcaccctttcgggttaggtcatatttcataccctatttgcaccattacagtacaaccttcgctttctctaacttcttttacctacaccaccaacagcattgcttacgcgttgcctgccatttttcaggcggagatataggcttaccaagttccattattactacatggatagggaagatatagtcttttttcccgacagtgtttatgatgacgtatcccaaggctaaaatgagataacccactgcataccttttggttcaagccgatagcgaccgtaggcttgttctacataacgagaattacgactattcacttacgtttatctttctatccaacctagtccctcaacccaatggtcgtttcgagtctcttattaatacttcacagtattaataaccttatcgggggtacattgtcaggaagctccgcacaaaatcgttgccaattatgcactatccctaggttactgttagtcatataacaggttacactcatttatttcttcgcaactgcatatatcaacgttgaaacaaattgtaacaatagtaataacagcttactcatacttaactaagttgttacctaatacagcaataaataagcccttgctggtttgctttaaaacttactttatccattaaacaaatgtttaatagtactttgatagtactttgtttacgtttaatcctctaataggaaataactaacctttaacaaataaaaactcatttgttagtaatgattatttcaatgaaaggggatttgggtaaattttagaccgagaagtagcagtgctgttccgcaagccattcacgggcaactattactttcaagttgctgagggtgtttcttaataaaagaatatcccgaagtacagtaaataaagataagtgtaaaggtggcaaccaaatagaagaaattccactttcttatactcgaaccgtttcagattgctacggtatctttcggactttatttatagtagggttgaataatcattctttatggacgatatgacgttttggatttgacccaagtcactctataaataggcgactaacggtagtcctatctttcgataacggatcttgcttgcttactcctcttaatatttatctaaatattaagtacataaaagtgaagaccataccttattaccgcataaagttggagatattcttaccaacttagaactagatcttgagcaacgctccttttctagtctgctacccaaactcttcccgagaagatctggatagtcaagagaaagctacattacatagctttctcttaattgagttaaatccttgatatataaggacttaaccccagtaagcacaacacttgtcgcacttagcctttgtagttatgtacatgagcaactaaatctaatactttatttgagtagccagtttcattatcataccaagaaactaatttaacgaaagtatcagttaatgcaatacctgctgccgcatcgaatacagaagtcaagctacaaccgttgaaatcagtagaaactacagcgtcttcagtataacctaatacacctttcatttcattttcagaagcacgtttgatttctgcacagatttctgcataagttgccggtttttccaagtttacagttaaatcaacgacggaaacgtttggtgtaggaacacggaatgccatacctgttaatttaccattcaatgcagggataactttaccaacagcttttgccgcacctgttgaagaagggataatattttgtgccgcaccacgacctccacgccagtcttttgcagaagggccatcaacagttttttgggttgctgttgttgcatgaactgttgtcattaaaccgtctttgataccgaatttgtcattgataactttagctaacggtgctaaacagtttgttgtacaagaagcattagaaacaatgtcttgaccggcatacgcatcaaagtttacgccgttaacaaacattggcgttgcatctttagatggaccggttaaaacaacttttttcgcacctgcggtaatatgtttacgagcagttgcgtcatctaagaataaacctgtcgcttcaacagcaacatcaacaccgagctcattccattttaaattagcagggtcacgctctgatgtaacacgaatcgctttaccattaaccactaagtttccatctttgacttcaactgtaccatcaaaacgaccatgagttgaatcatatttaagcatataagccatatattcaacatcaattagatcgttaataccaactacctcaatgtcatcacgagtttgtgctgcacgaaatacgatacgaccgatacgaccgaaaccattaataccaattttaattgtcataatattttcacctataatattttaagttaaacgaaactcgatgctttacagaagtgcttagtctttctagttttcaggctggggtagattatagcataaattcttctttgattatagtgtctctagagtaaatccggcatatatagattttttatgatccacgtcaaagttgataatgtttgtaccacattgattttttagtgtagtatgtgcggagatttatgtttcatcgttaagcggaaaatgacttttcatatggaaataggaagaatatcatgttaaccaaccaaccaaccaaccaaccaaccaaccaaccaaccaaccaaccaaccaaccaaccaaccaaccaaccaaccaaccaaccaaccaaccaaccaaccaaatgaacgtttattttccatagtaaaggaagtttttccgaaaagtcatagcataaatttttctcttttaggaggaatgaccaacaagaattatctcctttatgttgataatgaaaaatatgtattgcgtctgccaggggtaatgacatcgaatttgatttcaaggcactatgaaatgaataatagtatattgatgtctcaggcagaatttaatgttgaaacaatttattttaatgctgataatggtattaaaataacgaagtttttagaaaaaggtatcaattttaatcataataatattcatcaatatgaatatttatttctcatctcaaaagaattatataaattacatcattcagatattcaatttaataatgaatttaatgtatttgaaacttttcaacaatattttgacttattaaaagataagaatggatttttctgctttaataaaaatattccattgatatacgaattttttattaaaatttcaaagaataattctttttataacatcaaatgtccttgccataatgatcttgttcctgagaatattttaatgaaaaacaataaattattttttattgattgggaatattcaggaatgaatgctccgttatttgatgtagcggctttttttcttgagtcgagaataccagaagaaaaacaaaaatatttccttgttcattatgatcatcatctggattttgaaaagtctcgtatggaaatactatttcatcaatttacccaagatgttttatggtttttatggactttgataaaagaagaaaataatgagaaatttgaaaattatgcctcaacaagaataaatcgtgcttatgaactgatgaaggagttggtgaaaaatgggtttatttagtgaagataaacgattagttcatgtcggttatttttgtggattattatccggtttattttgggcaatatcaggaatttcttacgaaaaattatatctagatttcccaatgctgaatgcgtttgcattaaatattattatattaagtattgctgagattactttgctgttaatggcttatggttatttgataaaaagaaaattattaccgcactttaataaggtttctttgttagcgattttgggaggttgtttgggtggtcctgttgggatgatttgctatttacagtccttacaatatgttggagtgagttatgcggcgacgatttcaatttgttatccaattatagcatctattttatccatcaagtttttagctgtgaaagcatcaagaagaacactattttcttttgtttttattgtcttattattaatgcctgtcatgtatcaaggtgaaaattcagaaatcaggattttaggcattatttttgctttttcttgtgcattatgttgggcacttgaaattgtgatttccagttatgtcatgcaacactatttatccgatcaagtttatttatttagacaaataggatcgtctttaggatattttcttattattcttttcatgtttttttatggaacttatgacaatttaattgattttaatttttttaaggatgtaaatctatggaaattggagtggatagttattatttcctcaggattttcttattttctatattataaatcaattgcaattttgaatccaattagagcaatggcattaaatattacatatagtctttgggcgattgtattaagtgcggttcttttatcaaaggaaattagtatctttctgcttatgattggaataattgtattgatgaatatttttattgtggcgaaaggagaagaaaaatgaatgccattattttagcggcaggtttaggaagtcgttttagagagattacgcagaagaagcataaggctttacttccgttacctaatggaattcctaatattgagcaaacaattatttatttaaagcaagcaggtattcatgaaattcacattgtaacaggttatttttctgagcagtttgattttttaagtggtaaatacggggttaatcttatttataataagttttataaaaagtacaataatatctattcttttcattgtgctattgagcatttcggagaaagttttgttattgacagcgatgtgacgctttttagcaatatttttaatgataaattaaaacgaagtcaatattttttaattcaacgaaataaaagtcataataaagaatggattccgatagtaaaagataaccgagttattgatattattattgacagtttggagttgccgagtttactgggtgtctctttttggtcaaataatgacgcagttaaaataaaatcatttctggctgattatgtgaataatgaaaatttattacttgattcatcattgtattgggataatattccaatggaaaatcttaaagaattggatattggtgtaaagcttttgaatataaaggaagcttatgaaatagataatttatccgagtatgaatttatatttcatcatttaaaaggtaaatagtatgaaaaaattatcattgagagaacttcaattggcatcattagatattttgaaatattttgatcaattatgtgctaaaaatgatattcaatattccttaggcggaggcacattaatcggtgcagtaagacacaaaggatttattccatgggatgatgatattgatgtctatatgcatcgtgatcattatcaaaaatttgttaatatttggaaaagtgagacgcatgataaatatgaattatctttagcggaggatattcatggtatgtttccaggggagatgacaaaaatttttgataaaaatactttaatcatagatacgaaaggaagaaaaagtggcatatttatagatatttttatttatgatagtgtgccaaatgccccggcggtgatttataaagttatgaagaaacatcgtcgccttaaattgaggttttcatcttgtcgtaagagatggtataaagctaataatgagagtttaattcagtctatattttttagattatcccagtatttatttaataagatgatgttaaatttaaaacaatttcaagacaaatatcctattgatgaggctgaatatataggacttgttttatcagattatggtggctggaagaagtcttatatgcctaaaaaatattttaactccgttgtttatttggattttgaagagagtaagtttcctgttatgaacggttatcatgaacatttgaccatgtattatggtgattatatggaactgcctcctgttagcgaacagaaacctcaacacacgattgaagcttatatattagattaggcaatctattccttttttattaaaaatcagcaaaagagcggtcattttgctgatttttttttgatttatcggcataataggtgttataaaaattttatgggagtcattatgtgtaggggaaatttatatattatttctgccccaagcggagcagggaaatcttctttgatttcagcattattggaacgggataaaaacgatagtatgacggtgtccatatcacatacaacaagatccccaagaccgggtgaaattgatggggtgcattatcactttgtttcacatgaaaaatttgaacagcttattttagaaaactcatttttagaatatgcgaaagtattcggtgggaattattatggtacgtcattactgaatattgagaaaaatttagcggcaggtatagatgtattcttggatattgattggcagggagcaagacaaattcgagaaaaacgtcctgatgttaaaagtatttttattttgcctccttctatttctgctttagagaagcgtttgattgggcgtggtcaagatagtcaagacattattgcaaagagaatggaaaaggcagcggatgaaatctcccattatgatgaatatgattatgtcattattaatgctgattttgatcaagcattagtagatttagaacatattttgcgagctgaacgattgactgtaaattatcaaaaaacgcaaaatgcggctttaattcatcaattactagtaaaataattttggttttagtatcatgagagcgttttttgtgaatacattaatggagaaattatggctcgagtaacagtacaagatgcggtagaaaaagtaggtaatcgttttgatttaattttaactgcggctcgccgtgcgagagaattgcaattacataagcgtgaacctttagtgccggaagataatgataaaccgacagtcattgcgttgcgtgaaattgagaaaggattaattaataacgatattatgaacgctcatgagcgtcgtgaggcattagaacaagaaactgctgaattgaatacaatatcgctgttatatcaaaataattaagtaaagtgcagttcttttttgtaaactttatcaagtacatttcaatcttttttgcatattaatcaatagtcaggtgtcttttgtatttatttgagagtttagagaaaattatcagaggatatttgtctccgtcacaaattgagttagttcggcatgcttttgttattgcaagagatgctcacgaaggacaagcgagggctagtggcgaaccttatattactcatccggttgccgttgcttctattattgcagaaatgcatttggatcatgaagcagtggttgcagcgttattgcatgatgtaattgaggagacgccttatactgaagagcaattaaaagaagagtttggtgcgagtgttgctgaaattgtggagggtgtttcgaaattagataaattgaaatttcgtacacgtaaagaagcggaagtagagaattttcgcaaaatgattttggcaatgacaaaggatattcgtgttgtgttgattaagctagccgaccgtactcataatatgcgtacactgggtgctttaagaccggagaaacgccgtcggattgcgaaagaaaccctagaaatttatgctcctttagctcatcgtttagggatagagcacattaaaaatgaattagaagatttaggttttgaagcaatgtaccctcaacgttatgcggtattacgaaaagtgattcaaattgctcgtggtaatcgtaaggatatgattgagtgtatcgcttcagatattaaaggacgcttgacggaggtaggcattacggcacgagtatttggtcgtgaaaaacatctttatgctatttaccaaaaaatgcgattgaaagatcagcagtttcattccattatggatatttatgctttccggacggtggtaaaggatgtggatacttgctatcgagtacttggtcaaatgcacagtttgtataagccgcgtccgggacgggtgaaggactatattgctgtacctaaagccaatggctatcaatctttgcatacatctatgattggaccacacggtgtacctgtcgaagtacaaattcgtacggaagaaatggatcggatggcggaaatgggtgtggcagcacattgggcatataagcaatcaggacgaaatgacagtacaacggcacaaattcgagctcagcgttggttgcgaagtcttgtggaattacagcaaagtgttggtaattcttttgagtttattgaaagcgtaaaatcagagttctttcctaaagaaatctatgtatttacccctaaaggacgtattgttgagttgcctaaaggtgcaactgcggtcgattttgcttatgcggtacatacagatgttggacatcattgcgtggcagctactgttgatcgtaaaccttatccgctttcctttgcattacaatcaggtcaaacgattgatattagtatcgatgaaaattcaaaaccaaattcggggtggctaaattttgttgtgacagcgaaagctcgcacaagtattcgccaagcattgaaatcgttaggtgccgatgatgctgttaatttaggcaaacgccaattactgcaggcacttttacctaaaaaacttagtgatattccaccgcacattgtgcaagaagttttagatgatttgaaattaacgagttttaatgacttgctgatggaaattggtttaggaaatcagattagtggagcaattgcttatcgattggtgggtgagccattgaaaattgatacggatggtaatcctaaaaataatacggaattattgcaaattaagagctctgaaggtttatcaacaacctttgggcaatgttgtcatcctattccgggagatccaattgtggcttatacgagttcagggaaagggcttgttattcatcataaggattgcgctaatttgaaaaaacgtaaagagaatactgaacattatatgcaggtacaatgggaggatgaagatacctcgattgagtttgaaactgagttgcgtattgaattactaaaccaacagggtgctttacctcatttaatgtcaatgatttcttctttggatagtcgcattcatagcatttggacggaagagcaagacggtcgcctttaccaaattgttattttattaaccgtgaagaacacagaacatttggagcaaattatgcgtaagattaaaagtgttcctggctttttatctgtcaaacgcaacattaataattaatgggtggacaattcttagacgctattccacttacttctttgtcgggtgtcggtgccgcaatagcagaaaaattaggtagaattgggctttttagcctgcaagatcttctgtttcatttgcctattcgttatgaagatcgtacccgtattacccctattattgatcttcgtattgatcaacatgcgacaattgaaggaatagtacaaacttgtgatattcaatttggtcgtcgtccagttcttgtggtgacgctttctgacggtactgccaaaattgccttacgcttttttaattttaatgcaggtatgaaaaatggctttcagcttggagcgagggtgaaagcctttggggaaattaagcgtggtcgatttatggctgaaattcatcaccctgagtatgaaattattcgtgataatagacctcttcagttagcagaaacgctcaccccaatttatgcgacaacggaaggtttgaagcaaaatacattacgaaagttgactgagcaggcattagcgttgctagaaaaaatgccattagcggaattattgcctagagcttttaatccccatgattttagtttaaaacaggccatttacgttttacatcgcccaccaccagatatttctttggaattgttggagcaaggaaaacaccctgcacagttacgtttaatttttgaagaattattagcacataatcttgctatgcaaaaagtgcggtgcggatctcaacatttttcagctttacccttacgttatcaaacagcattgaagcaaaattttcttgatttattgccatatcaaccgacaaatgcacaacaaagagttgttgctgaaattgaatatgatctgggacgttctttcccaatgatgcgtttggtacaaggcgatgttggctccggtaaaactttagttgttgccttagctgcattaactgctattgataacggtaaacaggtagcactcatggtgccgactgaaattttggcagagcaacatactgcaaatttccaacgttggtttgaaccgttaggaataagagtgggttgtttgacaggaaaagtaaaaggcaaatttcgtcaagccacattggaggagatatcccaaggcaatatacaaatggttgttggtactcatgccttgtttcaagatgatgtcaagtttgccgaactggtattagttgttattgatgaacaacatcgctttggtgtacatcaacgcctgatgttgcgtgaaaaaggaaagtatgccggtatttatccacatcaattaattatgactgcaacacctattcctcgtacattggcaatggtagcctatgcagatttagatacttcaattattgatgagttacctccgggaagaacaccaattcaaactattgcggtatctgaagaacgcagaaccgaaatcgtcgctagggtgtataatgcttgtgttaatgaaaaacgccaagcgtattgggtttgtactttgattgatgaaagtgaagtattagaagcccaagcagcagaaagtattgcagaggatctacaaaaagccttgccggtactacggattggtttgatacatggcagaatgaaagtgagtgaaaagcaagaagtaatgaggcaatttaaaaatgctgaattgaatttgttggtcgctacaacagtaattgaagtcggggttgatgtacctaatgcgagtttaatgattattgaaaatgcggaacgattaggtttggcacaattacatcaattgcgtggtcgggttgggcgtggtagtacggcatcctattgtgttttaatgtataaatcacctttgagtaaagtatcgagaaaacgtttagaagtaatgcgttcaagtcaagatggcttttttatttctgagcaagatttagaaattcgtggaccgggagaagttttaggtaccaaacagacgggtgttgcagagtttaaagtggctgatttaatacgagatcgtaaaatgctgcctactgttcaacattatgcccgtctattaattacacgatctccaaagttagcagatgacctcattcagcgttggcttaaaaataaagaaatttataccaatgcgtaagtgaacatttaacttttgtggaactgagaattatataagtaaagagcggtcaatttttaggaaaattttatgaggttctcaatacaaccaacaattttattttttgattcaggtgtaggtgggttgagtgtttataaagaaactaaacaacttttaccggattgtcattatttatatggttttgataacggattttttccttattcagaaaaggacgaaaaagatattattgaccgcactttaagaatttgtcagaaaatcaatcaaacttatcccttagatttaattgtaattgcttgtaatacggcaagtacggttgttttgcctgaattacgccggaatttttctattcccatcgtgggaaccgtacctgcgatcaagcctgctgcagaaatgtcagaaacaaaacatattggtttgattgcgacgaaaggaactataaaaagaacttatgttaatgatttgattaaaaattatgcatatcattgcatggtggaaaaaattggtagcactaagttggtagagattgcggagcaaaaattacgaggcggtgaagttgatcttaatgtcctaaaacaagaacttagtccatggaaaactatgaaatcacttgattctgttgtattggggtgtacacattttcctctaatcaaagaggaaatagaatgctgtttaccgcaggtaaaattttttgtgagttctggtaaggcaattgcgaaacgggttaaatttttattaaaaggtatagaagtgcggtcaaaaattcagaaaaaaaatttgattttttgtactaaacctcttgaagatgataagtctgttcaacaaattttagattttggggaatttgagaatttagtgatattgtctgattgagaccaagcaactagacaaaaataaaacttgtattttgtaattgaatagatttttactcagataaatgtaggaaaattgagcaaatagtttttattttagacaaaggagaatatttttaaaaaaaattataaaaaaagcttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgtgggcgttggagaattgaggggggctgctcctagtacgagaggaccggagtggacgcatcactggtgtaccagttgtttcgccagaagcattgctgggtagctaaatgcgggagagataagtgctgaaagcatctaagcacgaaacttgccttaagatgagttctccctaatgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaaactaacaaaataaattttggcagtcatagtgcaatggaaccacctaactccttgccgaacttagaagtgaaacgttgttacgccgatggtagtgtggggattccccatgtgagagtaggtcactgccaaatatcaaatttagcggagtggtagttcagctggttagaatacctgcctgtcacgcagggggtcgcgggttcgagtcccgtccattccgccaatttatatctgtttaggggcgtagttcaattggtagagcaccggtctccaaaaccgggtgttgggagttcgatcctctccgcccctgccatgttttccttagtcatatatttcattaaaattttttatctcatatcttttcatagtttcaaaaatgcaatattctattacaagacgaagaatatgcagcagttaatagaaattttggtggcattttcttatcaaaaaactcagtaaaatctatgtggagacaattgtgggaaataaaatcttaaaagggatttttttgctctatccgccgctgcgttgaatagtagtattggaatttttagcaaaaatttattagagcagaacctaaatattcaatctattgccttttttaaaacaattatcgcttttgctatgatcagtctggtgttaagtcgctcatcatggcaagaacagaaaaatcaaataaaaccttttgcaaaaaatacagtgaacctacttttccaaatagctatttgcgcatttctggggattttaccttatttttctttgaaaccactgcttatcagtatggccatgccgctaatgtggtagtcgtactaatgaccgctgctgccgtatcctccctgctcggagggctatattattgtcagagccattgaaggtttccgccattgctggtacttgttttgccgtatctggcgtatttatcatttcttggtcgggctctagtcaatggctatctattctatatgccattcttgcaggtagtggctacggtttattttccgtactcattaaaaaatttaatttaaatggtggcataccattaacacgattattgatgatgtttggagcactatatttgttctatccatttgtcacacattttcaacatatagaaatccagtggaatacgactgttatactcaatcttgttgcacttgctttactacccacgctgattggtttttactgcacaaccaaggcgttagtttatctcagtgcatcgaaagtacaggtaactgaactgtcagaacctatcttcactatggtactggcatggctactactcaatgaagttccaaatcaaactttctttttaggtgcgttttgtattgtgttaggcattgcgttgatcaatcaaatgttgcacttcaaaaagtgagaagtgagttctaacaggttatgtacgctatgtgtagggtattttgatgggtatgagttttatatttaatcgatacgatttttaggcgacctgaaaactcatttttatacttacttacttcctttcttttctacaaatttaattattttttgtattatttaaataaattaattgagcgatttcaaaaaataagtatgatagccggagttttttgtttatctcttttaaggagcttttatgctttatttggaatttttatttttacttttaatgctttatgtaggaagtcgctatggcggtattggattaggtgttgtatccggtattggcttagctatagaggtctttatcttccgtatgccagtaggtaaggcaccaattgatgttatgctaattatccttgctgttgtgacttgtgcgtcggtacttgaggcagcgggcggtttgaaatttatgctacaaatggctgaacgtgtattacgtagcaatcctaagcgtgtaactatccttggacctttagtaacatattttatgacatttatgctcggtacagggcattctgtttactctattatgccaattattggtgatgtagcactaaaaaataatattcgtccggaacgacctatggctgcagcatctgttgcatctcaacttgcaattacatctagtccattatcagcggctgttgttttttatcttgggaaaatcaccgcacttccaggatttgagcatattaccttattagatattatttgtgttactgtacctgcgacattggcaggaactattgcattgtcactttatagtttacgccgtggtaaagagcttgaatatgacaaggaatatcaacgtcgtttacaggatcctatttggcgtgagcgtattttaaatacaactagtacaactttaaatgaagtattaccgccagcagctaagcagtcggtatatttatttttactctcgttagttgtgattgtaatgatcgcaatgtttcctgaaattcgtactatcggtagtgcttctaaacctatttcaatgtcattaattattcaaatgatgatgctatgttttggcggtattaccttgttggttacaaaaactaatccacaagttgtaccgaacggtgttgtatttaaatcaggaatggttgcagcaattgctatttttggtattgcctggatgagtgacacttattttcagtatgcaatgccacaatttaaggcaggtattgtagatatggtgaaagcctatccatggacttttgctttggcactatttgctgtttcagttgttattaatagccaagcagcaacagcggttatgatgttacctgttggaattgaattaggtttatctccagcattattagttggtctgatggcggcaacatatgcttatttctttattcctaattatccatcagatattgcaacggtgaactttgatgtgacaggtacaacgaaaattggtaaatattactttaaccatagctttatggctccaggtttaataggcgtttttacggcttgtgtggttggctacctcattgcacaagttgttattcgttaagttcatcaaataaaaagtgcggtttaaaaccgcactcataccgttaacagtttgatacgagagatattccgtaaaaagcaacatcactcagcattgtgaggtaacttttttgctttggttgtttgctaatttgtacttcacgtaattctttgacatgggcatagagatgtttttagaataaaacctcattcaatcgtcaaatgtatcttgctaaaaactatttggaatgatagaatctcaagccattttagtaaattgctgatagttttatactctcagcaatttacattttttaaatacaccgtttgattgcaaaagagttaggctaaatcaaactattagcttaatgcaatccgcacatcagaagtaaggttcagagggcggtacctagcaaacgggttcaagcattgatataaaatttattataaaatcgaccgcactttatgttgtcgaactgaattttatattgaatcggtctcactaatatttacagaggaacccaaatggtttactcctataccgaaaaaaagcgtattcgtaaaagcttcggcaaacgtccgcaagttttaaatgtaccttatttattaacaattcaacttgactcttttgataaatttatccaaagagatcctgacggtcaacaaggtttagaagctgcattccgttctatatttcctattgtcagtaacaatggtaatacagaattgcagtatgtcagttatcaattaggagaacctgtttttgatgtaagagaatgtcaaattcgaggtactacttatgctgcatcattacgtgtaaaattacgccttgttagctacgataaagatgcggcatccggcacgataaaagacataaaagaacaagaagtttatatgggagaaatcccattgatgaccagtaatggtacttttgtcatcaatggtactgagcgtgttgttgtatcacaattacatcggagtccaggtgtattttttgatagtgacaaaggaaaaacccattcatcaggcaaagtactttataatgcacgaattattccttatcgtggttcatggttggattttgaatttgatccgaaagataatttatatgctcgtattgaccgtcgtcgtaaattaccggctactattattttacgtgcattaaattacactaccgaagaaattttggatttattctttgataaggtttcgtttgagatcaaagataataaattactaatgactttagttcctgaaagattgcgaggtgaaaccgcatcttttgatattgaagcgaatggtaaagtgtatattgagcgtggtcgccgtattaccgctcgtcatattaaagcattagaaaaagataagattacacaagttgaagtaccgacagaatatatcgtaggtaaagtttcagctaaagattatgttgatttaacaacaggtgagattatttgtccggcaaatatggaaatttcgttagaattgttagagaaattatcacaagccggttataaaaatattgaaacgttatttaccaacgacctagattttggtccgtacatatctgaaacattacgtgttgatccatcctatgatcgtctaagtgcattagttgaaatttatcgtatgatgcgtccgggggagccaccaacaaaagaggcggcagaaggtttatttgataacttatttttctcttccgaacgttatgatttgtcagctgtaggtcgcatgaaattcaaccgctctttgggcattgaagacactacaggtagcggtacattgagcaaagaagatattgttaatgtaatgcgtaaattgattgacattcgtaatgggcgtggtgaagtagatgatattgaccacttaggtaatcgtcgtattcgttcagtgggtgaaatggctgaaaatcaattccgcattggtttagtccgtgtagaaagagcggtaaaagaacgtctttctttgggcgatttagagtcggttacaccacaagatttaattaatgctaaacctatttcagcagcagtaaaagagttctttggctcttcacaactttctcaattcatggatcaaaataatccgttatcagaagttactcataaacgtcgtatttctgcattaggtccgggtggtttaacacgtgaacgtgccggctttgaggttcgagatgttcatgcaacgcactatggtcgagtttgtccaattgaaacccctgagggaccaaacattggtttgattaactcgctatctgtttatgcacgtactaatgattatggtttcttagaaacaccatatcgcaaagtggtaaacggtcaagtcacagaagaaattgaatatttatctgcgattgaagaaggaaaatatgttattgctcaggcaaactcaaaccttgacaatgagcttcgttttactgatgcctttgtaacttgtcgtggtgagcatggtgagtccggattatatcgaccggaagaaattcattatatggacgtttcaactcaacaagttgtgtccgtcgctgcagcacttatcccattccttgaacatgacgatgcaaaccgtgcattaatgggtgcaaacatgcaacgtcaagcagttccaaccttacgtgctgataaaccgttggtgggaacaggaatggaaaaacctgtagcactggactctggtgtagcggtggtggcaaaacgtggaggtactatccaatatgttgatgcttctcgtattgttgtaaaagtcaatgaagatgaaactattgcgggtgaagcggggattgatatttacaacttaattaaatatacccgttcaaaccagaatacttgtattaaccaaattccttgtgtgcaattgggagaaccgattgaacgtggtgaaatcttagctgatggaccatcaacggatctcggagaacttgcacttggtcaaaatatgcgtgtcgcattcatgccttggaatggttataactttgaagactcaatgttagtgtctgagcgtgtggtacaggaagatcgtttcactactattcatattcaagaattatcttgtgtggcacgagatactaaattaggttctgaagaaattaccgccgatattccaaatgtaggtgaagctgcgttaagtaaacttgatgaatcagggattgtttacatcggtgctgaggttaaaggtggagatattcttgtcggtaaagtaacacctaaaggcgaaacccaattaactccggaagaaaaactgctacgtgctatttttggtgaaaaagcatctgatgttaaagactcttccttgcgtgtacctaacggcacatcaggtacagtcattgatgttcaagtcttcactcgtgatggtgttgaaaaagataaacgtgcattagaaattgaagaaatgcaattaaaacaggctaaaaaagatcttgtagaggaattagagattttagaagccggtttgtttgctcgagtacgtaatttacttctttccggtggtttcaatgataaacaattggaaaacttagaccgcactcaatggttagagcagactttagttgatgaagataaacaaaatcaattagagcaacttgctgaacaatacgaagagttacgtaaagatttcgaacataaacttgaaattaagcgtagtaaaattatccaaggtgatgatttagccccgggagtattgaaagttgtcaaagtttatcttgcagtaaaacgtcaaattcaaccaggtgataaaatggcgggtcgtcatggtaacaaaggggttatctcgaaaattaaccctgttgaagatatgccatacgatgaaaacggtcaacctgttgatattgtcttgaacccgttaggggtaccatcccgtatgaatatcggtcagattttagaaactcatttgggactggcagctaaaggcattggtgatcaaatcaacgcaatgataaaacaaaaacaagatgttgaaaaattacgtggctatatccaaaaagcttatgatttaggagatggttcacaaaaagttgatctttcgacctttactgacgaagaagtattgcgtttagcaaaaaacttgcgtaaaggtatgccattagcaacgccggtatttgacggtgcacatgagaaagaaatcaaagcgttattagaattaggtgggttaccaacttccggtcaaattatcctgtttgatggtcgtacaggtgaaaaatttgaacgtcctgtaacggtaggttatatgtatatgctgaaattgaaccatttagttgatgacaaaatgcatgctcgttcaacaggttcatatagtcttgttactcagcagccacttggtggtaaagcacagtttggtggtcaacgttttggtgagatggaagtatgggcactggaagcatatggtgcagcctatacattacaagaaatgttaacagtgaaatccgatgatgtgaatggtcgtacgaagatgtataaaaacatcgttggaggcacacaccaaatggatccaggtacgccagaatctttcaatgtaatcatgaaggaaattcgttcattaggtatcaacattgatcttgatgaagagtaatgggtaaccacaaaaatacgcccaagtgcggtgggatttataaaagttttaaccgcacttgaataattttaactccgataggagcaaatcgtgaaagacttagttaagtttttaaaagcacaatcaaaaacctctgaagattttgatgttattaaaattggtttagcatcaccggatatgatccgttcttggtcatatggtgaggttaagaagcctgaaacaattaactaccgtacattcaaacctgagcgtgacggtcttttctgtgcccgtatttttggaccggtaaaagattatgagtgtctatgcggaaaatacaagcgtttgaaacaccgtggagtgatttgtgaaaaatgcggtgttgaagtaacacaagccaaagtacgccgtgaacgcatggggcatattgagcttgcctcacctgttgcacatatttggttcttaaaatcattaccgtcccgtattggtttattgttggatatgccactacgtgatattgagcgtgtactttattttgaatcttacattgttattgaaccgggaatgactgatcttgagagaggtcaattattaacggaagaacaattcttagacgcagaagatcgttggcaggatgagtttgatgcaaaaatgggtgcagaagcaattcaagccttgttacgtgatatggatttagaagttgaatgtgaaacattacgtgaagaattgcaatcaacgaattctgaaactaaacgtaagaaaattacaaaacgtttgaaattgttagaatcttttatccagtcaggcaataagccggagtggatggtgatgacagtattacctgttttaccaccggatctacgcccattagtacctcttgacggagggcgttttgcaacatccgatttgaatgatttatatcgtcgtgtaatcaatcgtaacaaccgtttaaaacgcctattagatttaattgcaccggatattatcgttcgtaacgaaaaacgtatgttacaagagtcagttgatgcgttattagataatggtcgtcgtggtcgtgcaatcaccggttcaaatcgtcgtccgctaaaatctcttgcggatatgattaaaggtaagcaaggtcgtttccgtcagaatttattagggaaacgtgttgattactcaggtcgttccgtcattacagttggtccatacttgcacttacatcaatgcggattgccgaaaaaaatggcattggaattattccgtccatttatctacgctaaattagaaagtcgtggctttgcaacgactattaaagctgcgaaaaaaatggttgagcgtgaagatgctattgtttgggatattcttgccgatgttattcgtgaacacccaattttgctcaaccgtgcaccaacattacaccgtttaggtatccaagcatttgagccaattcttattgagggaaaagctattcagttgcacccgctggtttgtgcggcatttaatgctgacttcgatggtgaccaaatggctgtacacgttccattgacattagaagctcaattggaagctcgtgcattgatgatgtccacaaacaacattttatctccggcgaatggtgagccgattattgttccttcacaagacgttgtattaggtctttactatatgacacgtgataaagtcaacggtaaaggcgagggaatgttattacaagattcacgtgaagcagaaaaagcctatcgtacaggtcaagctgaattgcattctcgtgtaaaagtgcgtattactgaatatgttaaaaatgcaattggtgaatttgaacctcaaacacatttagtcgatactacaattggtcgtgcaattttatggatgattgcaccaaaaggcatgccatttagtttattcaaccaaactttaggtaaaaaagcgatttctaaattaatcaacgaaagttatcgtcgtctaggattgaaagagagtgtattgtttgctgaccatattatgtataccggttttgcttatgctgcacgttccggttcatctgttggtattgatgacatggttattcctcagaaaaaatatgaaattatttctgctgcggaagaagaggttgctgaaattcaagaacaattccaatccggtcttgtaacagctggtgaacgctataacaaagtaattgatatttgggctgcggcaaacgaacgtgttgctaaagcgatgatggaaaatctttcgcaagaagaggttatcaatcgtgaagggcagccggaaaaacaagcctcattcaatagcatctttatgatggcagattctggtgctcgtggttctgcggcacagattcgtcagttagcggggatgcgtggtctaatggcacgtccggatggctcaatcattgaaacaccgattacagcaaatttccgtgagggtttaaatgtattacagtactttatttcaacccacggggcacgtaaaggtcttgcggatacagcattaaaaaccgctaactcaggttatctaacccgtcgtttagttgatgttgcacaggacttagtgattatcgaagatgactgtggtacacatgaaggaatcgtaatgactccacttatcgagggtggcgatgtaaaagaagcattacgtgatcgtgtattaggtcgtgtagcggcagaagatattttaaaaccaggcacaaacgaagtgttaatttctcgtaataccttattagatgaaaaactttgtgatgtcattgatgaaaattctgttgatagcatcaaagtgcggtctgttgtaacttgcgatactgattttggtgtgtgtgcaaaatgttacggacgtgatttagcacgtggacatttgattaatcaaggtgaagctgtcggtgttattgccgctcaatcaatcggtgaaccgggtacacagttaaccatgcgtacattccatatcggtggtgcggcatctgctgcggcaaaagaatccagtgttcaagttaaaaataccggtacattacgtttaacaaatgttaaattcgtaacgaataaagaagggaagttagttttaacttcacgtaacactgagttgacaattattgatacattcggaagaacaaaagagcattataaagtaccttatggtgcggtattaaatcatgctgatggtgaagaagttacggcaggtgaaaccgtggctaattgggatcctcatacaatgcctgttatttctgaagtcagtggttttgtgaagtttgtggagattgttgatggactaacggtaactcgccaaaccgatgaattaacagggttatcttcaatcgtagttcaagatgtaggtgaacgtgcaacagcagggaaagatttacgtccggcattaaaactggttgacgctcaaggtaacgatatttttatcccaggcaccgatgttatggcacaatatttcttaccgggtaaagcaattgttagcttagatgatggtgcggaagtctttgttggtgaaccattggctcgtattccacaagagtctgtaggaacaaaagatattaccggtggtcttcctcgtgtagcagatttatttgaggcacgtaaaccaaaagaaccggcaattttagctgaaatttctggtatcgtgtctttcggtaaagaaaccaaaggtaaacgtcgtttgttaattacaccgatggaaggtgaaacatacgaagaaatgattccaaaatggcgtcaattgaacgtatttgaaggtgagttggtgcaacgtggtgatttaatttctgatggtgcggaaacaccacatgatattttacgtttacgtggtgtacatgccgtaacagattatatcgttaatgaagttcaagaagtttaccgcttacaaggggtaaaaattaacgataaacatattgaagttatcgtacgtcaaatgttacgcaaagcgattatcactaatgcttatgactctgaattcttagagggagagcaggtcgaagtcgctagagttaaaattgtcaaccgtaaacgtgccgaggaaggtaagccacttgtagaattcgaacgtgaattattagggattactaaagcgtcgttggcaacggaatcctttatttcagcggcttcgttccaagaaacaactcgtgttctaactgaagcggcagttgcaggtaaacgtgatgaattgcgtggcttaaaagaaaacgtgattgtaggtcgcttaattcctgctggtacaggttttgcatatcaccaaaaccgccaaaaaaatcgattggtaggtggtatggaaaatacgactgaggttaaattatctgcagttgatgaggaagaaattgcttctgaatttaccttttcagcagaagatgcaacagcaaatttggcagagatgctaaatatggcagatgatgcagaataataagtagcttggtacaaaatatttaattttaaaaaccgatatttatgtttgtaaatatcggttttattgtttagataataaagtacatgcaacattattaaaaccgaaaatctgtgtcatattcaatgatcacgactattgttcaaaattttctgtaatatagaggaaacggagaaacttcatttttaaaggatttgctgaaaggtattttgtatgaaaaaagctttcaacagtgtgaaatgcctgctataacttttgtaattttcgtttccgttttatacaatattcagcaacataaatgtcttcaagtaattaaccttaatagtggaacacctcatggaaaaaagcttatcccttattcctaatatcagaatgaaacgagaaggaatgacaaatacggaaaaacgagtagttgactggttattagatgcaactaaatttaataaatccacagcattgaatgctattgcaaatgatcttgacgtatctgaggctttaattgtaaaagttgcaaaattactcggtttctccggttttcgtgatttaagaaaacaaatcactacttcttttgaagaaaatcaattagatacatttgaactttccagtcaagatacgcctcaagatcttgtagataaggtttttaatgtctctttacaaacaatctctgaaggcaaggcgattttaaattccaaagtcatttctgaagctgcaaaatgcttttttaatgctcaaaatagagatctgtatgctgctggtggttcaaatacaatctgcgatgatattgaacataaattcttgcgtatcggaattcgctgtaatacctatcgagatattcatttaatgatgatgtcagcctcattactcactgaaaatgatgtgatcttagtggtttctcattcgggtaaaacaaccgatttgttaaaagttgtctatgaagctaaacaaaatggagcaaaaattatctgcatcacacatagtgatatttctcctattgctgttatttcggattttgtaatttgtacgcccgcaccagatactccattgctgggaaaaaatgcttcagcaagaattttacaacttattttagttgatgccttctttgtctctgtagctcaacaaaatattcacttatctgaaatgaacttagagaagacatttactgcaacaaaatacttcagaaaaaaatagcttccttccattaaaaaggtccttttttatcattaaaaactttacaatattttaatatttgtgaagttgatcacttttttacccctttcaataaagtataattataaaaaaataaataaaaattataaaaatatgaagtttaatcattttttataatttttagttttctattaacttacataaggagtaatttcatgaaaaggttcaaaacactaaaatcctgtttggctatacttggcttagtttgctctgtttcggtttattctgctgaatatgccgtaatacttaaaacgctttcaaatcctttttgggtagcaatgaaagaagggattgaaaatgaggcaaaagcactgggagtagatgtagatatttttgcttcaccatctgaaggtgattatcaatcacaacttcaattatttgaagatttaatcaataagaattataaaggtatcgcttttgctccactttctcctgcaaatcttgttatgcctgctgccaaagcctatcggaaaggtatttatcttgtgaatttagatgaaaaaatcgatattaaaaatttacaaaaggcaaaaggcaatgtagaggcatttatcacaacagataacgtagctgtaggtggaaaggctgctcaatttatagtagataaattaggttctgaaggaggcgaagttgccattattgaaggaaaagcaggcaatgcttcgggtgaagctcgtcgtcgtggagcaagagaagtttttgttaaaagttcgagcattaaattagttgctagtcaacctgcagattgggatcgtattaaagcactggatgtagcaaccaatgtactatcaagaaatccaaatctaaaagccttttatgtcgcaaatgatacgatggcaatgggggtagcacaagctgttattaatgctgggaaacaaggtaaaattttagttgtgggtaccgatggagttcctgaagcaagaaaaatggttagcgaaagaaaactcactgccactatcgctcaagatccggcaatgattggtgcaaaagggttgaaactgcttgttgatgcagcgagagcaggaaaacaaatacctgttgatgttgagccaaaaattgaaactgttgattcaatattaatttctcaataatacggaagtatgtggggattttaatctccacataggagtgtttttctatggcaatcccattaatacaaatgaaaaatatctcaaaaagttttggtgttgttcaggcattaaaaaatgtcaatcttgatatttatacgaatgaaattcacgcattactgggtgagaatggagcgggtaaatcaactttaatgaaagtcttatcaggattgcatatgccttcctctggttcaattatcattaaagataaagaatatgatcatttagatcacaaaatcgcaacagaacttggaattgggattatttatcaagaattaagtttaattgatgaattaagcgtacttgaaaatctttatatcggtcgtttaccaacaaaaaaattttggggtattcccattgttgattggtcaaaaatgcgttctcaagcgtctattattttattaagactaggaattaaagttgacttagatgagaaagtaggaaatttatctatttcttacaagcaaatgattgaaattgctaaagttcttatttcagatgtaaaaatcatcattatggatgaacctacctcatcattgactaactcagaaattgattacttatttttcattatgaatcaattacgtaatgatggaaaagcgattatctacatttctcataaaatgaatgaaattcgccaaatttgtgaccgttatacaattcttaaggacggaagtagtgtggcttccggtatgataaaagaaatcagtaatcaagagattatccgcttgatggtaggacgtgatatagaatctcggtttatcagcagacaacatactgtgagtaatgaggttatttttgaagttaaaaatcttataggtaaaaaatttaaacaagtcaataatgtttcattttccttaaaaaaaggggagattttaggctttgccggtttagttggtgcaggtcgtacggagttgatgaactgtatctttggcattgataaacgcatttctggggaaatttatttaaacggtaaaaagattacaccgtcatcaccattagaagcagtgaaaaaaggtatggcgtatatcacagaaagcaggcgtgagaatggctttttttccaatttttctatcaagcaaaatattgctgtttcaaaaagtttaaaagatggtggttataaaggtgcggtgggaattttttctccttcaaaggaagccaaacttgcacaacagcaacaagatcttttatccataaaatgtgcgtccattgagcaaaatattacggagctgtcaggtggtaaccaacaaaaagttattatcggaaaatggattgtttgtgatcctgaagtattaatttttgatgaaccgactagaggtattgatataggggcaaaaacagaaatttataaaattatgcgtaaattagcagaacagggaaaagctattttgatggtctcttccgaacttcccgaaattatgtctgtatgtgatcgcattgtggtattccgagaaggagctatttcctctattttagagaatactaaagcgttaacagaagaaactattatgcgttgggctttaccagagacaaaagaggtaaattaatgatgaatacaggtaaatttaatttttcgcaattttgggataaatacggcacattctttattcttgctgttattgtccttatctttggatctatatccagccaatattttttgaaagccagtaatattcagcaaatttttgttcaaagctcggtaacagccctaattggaatgggggaatttttcgctatattgatagctggtattgatttgtctgttggtgctattttagctctttcggggatggtgacagcacagttaatgattatagggatagatcctcttgttgcctctattattggtggcattctagtgggaggtggacttggtgctattaatggtgcgttagtcaattacacaggcttacatccttttattattacattaggcacaaatgccatttttagaggtattacactcgtcatttcagatgcaaattcgatttacggcttttcttttgagtttgttgatttttttgctcaggatattttcttcattcctgtaccggttatattcgttgtggttattgctattctactttggttcgttacaactaaaacacgattaggtcgtaatatctatgcgttaggtggaaataaagaatcagcatattattccggaattgatgtcaagtttcacactatggcggtctttattatttcaggtatctgtgccggtcttgccggtgttgtttctacggctcgattaggtgcagcagagccgttggcgggggttggttttgaaacttatgcgatagcaagtgcgattatcggcggaaccagttttttcggaggaaaaggacgtatttttgctgtcgttattggtggcttaattatcggtacgatcaataacggactaaatattttacaagttcaaacttactatcaacttgtggttatgggtggtttaatcatcatcgctgtcgcattggatagattaattagtcgttaattttttgaggtaacatcatgaaagtttttatttcaccatcactcatgtgcatggatcttactaaattcaaagaacagattgaatttttggatcaaaaagtagcttattttcatattgatattatggacggtcattatgtacctaacttaactctttcaccattttttgtcagtcaagttaaaaaactcgctacgaaaccattggattgccatcttatggtaactaacccagaaaattatattgatgatttggctaaagctggttgcgacatgatcactttgcatgtagaaaccatttcaggacaagcatttagacttattgaaaagatccggtatttagaaatgaaagtcggcatcatttttaatcctgaaacgccaattgaaaaagcaaaatattatttatctaaagccgataaagttacgatattgacggtcgatcctggatttgcaggtcaatcatttattcctgaaatgttagaaaaagtggcggaacttaaattattccgagaaactcatcaattaaattatgaaattgaaatcgatggctcctgcaacccgaagacttatgaaatgcttattaaggcaggtgcggatgtgcttatagtaggaagttcaggtcttttcaataattcagataatattgttgaggcttgggatatgcttgaaaaagagatagaaagaatattaagtaaaggaatgttgtaatgaagaaagtatttgttggtattgatatgggggcaacgcacattcgcatttgtgtgatggatgagcatcatcaaattctttctactgataaaaggaaaacattagaagtactcaaaaatcaaccgctctatggactaacaacattttgtaaagaatttacaactgactttattattcaacgaattgttataggacttcctgcagcagtttcattggatagaaaagaaattctttctgtacctaacttatctctttctaaacaagaactagacggacttgttccaatgttagagcaatattttcattgtgacgtacaattggaaagagatgttaatttacaattgatctacgatgttaatgattatcaacggaataataagttagtgataggtgtttatctaggcactgggatgggtttttcaatatggaaccaaggaaagctatttattggagggcatggtgtagcgggtgaacttggacacattccttacggtgatgaacatcttcaatgcgggtgtggcaatatgggatgtttggaaactaactgttcagggactgcactaagaaaatggtatgataaacaacaagcaaattatccattagagcaactttttgatagagcaattcaagagaaattcattcaaaattatcttatcaaagtcgctaaagcaattagtactgcggttaatttatttgatcctcatactttgattttgggcggtggcgtaattgacatgcaaaaattcccatttgaacaactaaaaatattgatcagaaaacacctgagaaaaccattaccttacaatgaattagaaatattaaaagctaaaccttcctctattaatggggcaataggcggtgctatttacgctataaataaggagaaatgatgaaaacaatcgctattggttcggatcatattggtttggcactcaaaacctttttaattgaaaaattagaaaaacagggacataacttactagacttaggtgctgtttcacaagaacgtacagattaccccatttacgctgaaaaagttgcttatgctgttaagcggaatgtagctgatgttggaattttaatctgtggaacaggagttggcatttctattgcagcaaataaaatctcaggcattcgatgtgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgacatgatggaaatgcttgaaaaaacaggaagttattgtggattggttactgaaagataaaatctataaaataatataaatatctaagaatatttaaattatgctataaccacacctatgaataaactttgctctatcggacaagcaggtaaattgctaagcgtaactattcagacattgcaaaactgaggtagaaaagactgttacaagctgatgagctgaccaaaggttggtatcgcagatataaactggaaatgcttaaagcaattaatcacaatatcgtgcttaatcgagatgatttaaaaaccatttcttatgcaagagtaagtagccacactcagaaagaagattttgttcttataggtttgttttccttgtgaataatctaaccaaatattactcggatttaatttctttttgaaggcaaaaattttattacagcagatacatttaaaacgttttttggtgaggcaatctgttattagaaaggatttaaaatgttgggggtatttatgtaggaatccccgccctttaggacggggaagtgttgagttttagttatagaataaagtggcttaaatcttcgttctctacgacatcacctaatgctccggtaacgtaatcaccgtcaattatgacgttttgaccgctcatttcactggcatcaaaagagatcttatccattaagcgttccataacggtatgtaaacggcgagctccgatgttctctgttttttcattgactctaaaggctgcttcagcgatttttttcaccgcactttcagtaaattcaatatcaaccccttcggttgccatcagtgcttgatattgttcggttagggacgcattaggttcagttaaaattcgttcaaaatcctttgcagttaaagcggaaagttcgacacgaataggtaaacgcccttgtaattcgggaattaaatctgatgggcgagcgacttggaatgcgccagatgcaataaataaaatgtgatcggtttttaccataccgtgtttggtattgactgttgaaccttccactaatggcaatagatctcgttgtacgccttcacgagatacatcagcaccgctgtattcgccttttttgcagattttgtcaatttcgtcaataaagacaattccattttgctcaaccgcatcaatggctttttgttttaattcttcaggattaattagttttgccgcctcgtcatcaattaatgcttttaacgcatctttgattttcattttgcgttttttagtttgaccggaagataaattttggaacattgattgcaattgattggtcatttcttccataccgggaggtgccataatttcaacgccgatatttggtgcggcaatgtcaatttcaatttcacgatcgtccaattgcccctcacgtaatttcttgcgaaaaatttggcgtgtgttggtattggtatctcgttcttcaatttgtccccattgatctttcgctgggggtaatagggtatctaaaactcgctcttccgccatttcttcagcacgaaaacgatttttttcaatttctgtttggcgtacaagtttcatggcactatctgttaagtcacggataattgaatcaacttctttacccacatagcctacttccgtaaattttgttgcttcaactttgataaatggtgcattagctaatttagctagacggcgggcgatttctgttttacctacgccggtaggccctatcattaaaatattttttggggtgacttcatggcgtaacggttcttgtagttgcattctacgccagcgatttcttaaggcaatagcaaccgctcttttggcatcagcttgtccaatgatatgttgatctaattcagaaacaatttcacgaggggtcatttcagacataatatattccttgacaattattcggataattcttcgatagtgtgggttaaattggtgaatacacaaatgtcaccggcaatttttaatgatttttctacaatttcacgtgcggataaatccgtattttcgactaatgctcgtgctgcagataatgcataatttccgccagatccgatcgctaaaatttgatcttcttccggttgtaccacatcgccattaccggtaataattaacgattctgttttatcagcaacaataagcattgcttctaaacggcgtaatgctctgtctgtacgccattctttagccaattccaccgcactttttaacaaatgtccttggtgcatttccaatttacgctcaaaaagttcaaataacgtgaaggcatctgctgtaccaccggcaaatcctgttagaaccttaccgttgtatagacggcggactttacgtgcattgcctttcattactgtattgccgagtgatacttgtccatcaccgccaaccacgacttgccctttacggcgaacgctgacaattgtagtcatttttgattccttaactttcttttcttttatctgtcgctatatgaggattaactgtgacctttcaaggatatatacaaaataaaattttgatttttgtagagggatagaatttaacattcttatttgaagcactaaaggagcgattgcattgaaattgattggacaatcgccgagattatattaacaatctgtcggatcaagtcgctaaatacagaaaatctctttataatgaccgcacttttaccgcaagtgcggtttctttttactatttttaaaggaagataaaatgacggtattgaaaaatgatcgttacttgaaagcgttactacgtgaacctgtggatatgacgcccgtttggatgatgcgtcaagccggacgttatttaccggaatataaagcaactcgtgcaaaagcaggggattttatgtccctttgccgtaatgccgatttagcttgtgaagtgactttgcaacctttacgtcgctatgatctggatgctgctattttattttcggatattctgactatccctgatgctatggggctgggattgagttttggtgtgggcgaaggtcctaaatttgcacgaccaattgataacaaaagtgcggtacaaaatcttccgattcccgaccctgaacaagagttacagtatgtgatgaatgcggtacgtactattcgccgtgagttaaaaggtgaagttcctcttatcggtttttccggaagtccttggactttagcaacctacatggttgaaggcggaagcagtaaagcctttactaaaatcaaaaaaatgatgtattccgagccaaaaatattgcatctgttattggataagttagcagacgccgtgatactttatcttaatgcacaaattaacgctggtgtgcaggcggtgatggttttcgatacgtggggcggtgtattgggacatcgtgaatatttggatttctcattgcaatatatgcacaaaattgttgatggcttaattcgtgaaaatgacggatataaagtgccagttactttgtttacgaaaggtggtggtttgtggttagaggcaatggcaagtacggggtgtgatgcactaggtttagattggacggtaaatttagcagaggcaaaagcacgagttgggcataaagttgcgttacaaggaaatatggatccttccgtattatatgcttcgcctgcacgaattgagcaggaagtacaacaaattcttgccgattttggacaaggtagcggacatgtgtttaacttaggacatggtattcatcaagatgttccggaaattagtccgaaggtttttgtggatgctgttcatcaatattcaatattctatcatcaataaaagtgcggtgaaaataatgcgaaatcctattcataaacgcttagaaaaatttgaaagttggaaaaatatcacatttatgctgtgtttatgtgaacgtatgtaccccaatttttatttattttgtcaaatgacagagcaaatggataaagccaaaatatatcaaaatattttgaatttagtttgggaatatttaaccgttaaaaatgccaaaattaattttgaaaatcagttggaaaaattagaaaatattattcctgatgtgaataattatgaattttttggtgttgtaccggcattagatgcctgtgaaggcttatcggaattattacatgcaattattgctggagaaacactggagaaagcaataaaaataagtcagttgtcgttgcaaactgtgataactttgctggaaactcagcaagacaaagcgttttctgaagccgagttgaagcaaagtgaagaaattgaattggaattggatgtacagtggcaaatttatcgtacgctgaatgagcctgaagaaagagatattagactgattttagatttaaaaaatgagttaagagagagcagggtgtctaatatcggtatagaaattgctcaataatgtgatttagttatcaatttttacagatattacttttttttctataaaacttagattatgcttgacaccactgtagttgcagtaattgttgccgctggaagatgagcgatctttttcggcacttttaaaaaaatttaatatgaagaaggtactaatttatgaataagacagacttaattgatgcgatcgcaggcgcagcagaattaaataaaaaacaagcaaaagcggcgttagaagcaaccttaggtgcaattgccggcagtttaaaagcaggtgaagctgtgcagttaatcggttttggtacatttaaagtgaatgagcgtaaagctcgtaccggtcgcaacccacaaaccggtgcagaaatccaaattgcagcatcaaaagtaccagcatttgtagcaggtaaagcgttaaaagattcggtaaatagctaagttatttttctctatctactttaaacctcgcatttgcgaggttttttgttatcttattttttctctacctctacctctacctttctttctaaatcaaaacgtatttacaattctttttttttatgtaaaattcgaaacgaaatttaaatcatggtttttttatgaaacgaaacttttatcctaggaatactgaacagcgtcgtcaagtgataatgcagttactgcaagacaagggagagattagtgttgagcagttagtgcagtattttaatacatctgaagtgactattcgcaaggatcttagtgcattagaaagtactggttttttattacgtaagtacggaggagcagttttaatactgcaagagccattggaagcaaatcacgaagaattactttctaatcgaaagttagctattgcaaaagctgctgcggaacgtattgctgataacaacagaattattatagatagcggtagtacaacagccgcacttattaagcaattaaataataaacaaggcttagttgttatgactaattctttgtctgttgcgaatcaattacgatctttggagtatgcacctacattattaatgaccggtggtacatgggataccggatctgaatcatttcaaggcaaagtagctgaacaagtattgtattcttataactttgatcaattatttattggtgcagatggtattgatttagctagaggaacgacaacgtttaatgaacttgttgggttaagtcaggtcatggcagaggttgctcaagaagttattgtcatggtggagtcacaaaaaattggtagaaaaatgcctaatttagaattaacttggcagcaaattgatgtattgattaccgatgagctattgagtgataaagttaaaaagcaaattgaattacttggcgtagaagtagtctgcgtaagtgcggtataaatttttttattttaaggaagtaattatgtgtggaattgtcggtgcagtggcacaacgtgatgtggcaaaaattttaattgatggattatatcgtttggaatatcgagggtatgattctgctggtgttgcaatattaaatgagcaacgtcatgtacaaattgtacgcagagtcggtaaggttcaggcattagatgacgcaattgaaaagcaacagttatccggaggaacgggaattgcacatacacgttgggcaacacatggggagccttcagaaattaatgctcacccacattgttcgggaaaaattattgttgtacataatgggattatcgaaaattaccaagaattacaagaagttttacaacaacgaggatacatttttcaatctcagacagatacggaagtgatttctcatttagtcgaatgggaattgcgtagtgcaaacactttactggaggcggtacaaaaagcgattgctcaattgcgaggcgcttatggaaccgttgtgatgaaccaagatgagccggagcatttgattgtggcccgttccggcagtccgttagtcattgggttaggtataggagaaaattttttagcttcggatccccttgcattattaaatgtaacacaccgttttatctatctcgaggagggtgatgttgcagaaattacatgccacagcgtggatatttttgattttaatggtaaacaagtagagcgagcagttcataagaataattttgagacagatgtaatagataagggaccttatcgccactatatgcaaaaagaaatttttgagcaaccgcaggcaatcatgaatactttagatgggcgtattttaaatggacaggttaatattgaggctattgcaccgaatgcagaggaaattttacggcaagtagaacatattcaaattgttgcttgtgggacttcttataatgcgggtatggttgctcgttattggtttgaatctattgcgagagtgagttgtaatgtggaaattgcctctgagtttcgctatcgtaagtctgtcaccagaccaaatagtttatttattacgctttctcaatcgggtgaaacagctgatacattagctgcattgcgtttagcaaaacaatctggggatatgtcggctatgacaatttgtaacgtagccagttcttcattggtgagagagtctgattttgcctttatgacacgtgccggcgttgaaattggcgttgcctcgacaaaagcatttacaacacaattaacttgtttacttttattaaatgtcgttcttggtcgtattaaaggatctattaatgtagaacaggaacgtaatatcattcgatccttacaacgtttaccggctcaggttgagagtgctttggtttttgataagcaaattcaaaaattatcagaagattttgcagaaaaacatcatactttatttttaggacgtggtgagtattatccgatagcgatggaatctgcattaaaattaaaagaaatttcttatattcatgcagaggcttatgccgcaggtgaattgaaacacggacctttagcattaattgatggtgatatgcctgttattgttgttgcaccggaaaatgatttgctggaaaaggtgaaatctaatattgaagaagtgcgtgctcgtggcgggcgattatatatttttgctgatcatgagttcggttttggtaatagcgatagttttaaaacgttggtattgccaaaagttgatgctatcacagcaccaattttttatacggtacctttgcagttattgtcttactacattgctttaattaaaggcactgatgtggatcaaccccgtaatttggcaaaagcagttacagttgaataaaaaatagtaaaagtgcggtaaaatttaccgcactttggttatttgattcaagttgctaccgtaaacagctattaccagccttttgcgacaccgtctttaaagtgcttataagcttcttgataaacttcctcagtttgataggcttttacaaagttttgtacttctacgctgtctttattatctttacgagcaacaataatattgacgtatggagaatctttatcttcagtaaagataccatgttctgcactgtttaaaccgacttgacctgcgtaagtattattgacaacagctaaagctacatcatctaacgcacgagcggcaacagaagtatctacttctttaatctctaaatttttcggattttcgataatatccaatgcagtagagaataaatttgtattatcttttaatttaattaatccttgtttttctaataaaatcaacgcacgagccaaattgcttggatcgttaggtacggcaactgtatcaccatctttcaattcactgatattcttaatttttttagaatagccggcaagcggataaacaaaggtgttacctacaatttccaagttggtgatatttttagattgtgtatctttatctaaataaggtttatgttgcatcgcattaatgtctaaatcaccttttgatacagcagtgttaggtaatgcgtaatcattaaatatgacaaattccactgctaagttatatttttctttagcaatctgagctgctttttctgccacttgatgttcaggacctgccattacgccgactttaatttttgccggtttgttttgatttgctactgtttctgtttttttatcatcgttacaagctgtcaaggcaacagttgaagcaatggcaatagttgcgaaaagtttgtttaatttcataagatttcctcttaaatagttgtgtttaaaataaattagcgatgatcaacttttttagctaaatcatcccctagtttttggctaataataacaaataacacgatgataatggttgaaatccaagtgatgaatcccatgccacgatgtactccgtagttaatagctaaacttcctaaaccacctccgccttgggttccagccattgcagtatagccaattagcgttacaaaagttaatgtaattccattgataagagagggtagagcctcaggtaaatagaattttgtaataatttgccaattggtagcccccaatgcttttgctgtttctgttagaccggttggaatttcaaataatgcattgctggttaagcgagcaaagaatggaattgcagcgacacttaaagaaacaatagcagcattggttcctaacgaagaaccaacgatatagcttgttacaggaattaagatcaataacaaaataatataagggacagatcgacctatattaataatgacattgaaaattttattagcattgctattttccagaatttgttttttgcccgttaaaaaggttacgcaaccaataggtaaaccgatgaggactgcgataaacgttgacacaatcgtcatataaacggtttcccaagtagaaagagcaattttgctccacatttccggcgttaattgttgattgaacgtaattagcagattatccaacatagcctaatacctccacacggacgttattttccattaaataaattttagtttgcgtgatggcttcttcctcaccttcaacttcggcaataacaaagccgaattttacctcaccggcgtaatctatttgtgaacttaaaatactgagatcgacgccaaattgtttagatgcttgagataataacggtgcatcaacggagcgaccggtaaattcaaatttgataattgggtaagattttgcatgttttggcgttgccggtaaattttccatatattcttccggtagattaatatggaaagttgaatgaataaactcttgagcaagaagggttttcggattagagaaaatatctccgacagaaccttgttcaattaattgccctttattaattaccgcaacttgatcgcaaatacgtttcaccacatccatttcgtgtgtaatcagtaaaatagtgatacctaaagtgcggttaatttcttttaataattttaaaatagattgtgttgtagccggatctaatgcactggttgcttcatcgcacagcaataccttaggactgtttgcaagtgcacgagcaatagcaacacgctgtttttgtccgccggataaatttgccggatagacatcttttttatcgtatagtcctactaaatttaaaagagcgtcaactttttgtttaatttgggttttatccgttttctctagttctagcggcagtgcaacgttatcaaagactgtgcgtgagcttaataaattaaagtgctgaaagatcataccaatatgacggcgagcatgaattaactcgttatctgaaagttgagttaaatctgtattatctacaatgacagagcctgaagttggacgctccaataaattgatgcagcgaataagagtactctttcctgctccggaggcaccaattactccacatatttgtcctcgaggtacttcaagactgacattatcaagtgcggtcagatttttgcctgaaacattgaacactttactgatattttttagcttaatcatataagcccttttctatatagttaaattaaaattagcttgtattttagacgtctagattgctatgtcaatatttattgaatagatttttataaggatttattagttattggcgatataataaagaaactttgtttttcatagaggtattatgtatatgaataaagcgatttttttagatcgagacggcacgttaaatatcgatcacggttatgtgcatgaaattgacaaattccagtttatagcaggaagcatagaagcattgaaacaacttaaatctatgggatttttattggttttagtcacaaatcagtccggcattgcaagggggtatttttctgaggaacaatttttacagctcactgaatggatggattggtctcttgcagacagaggcgttgatttagatggtatttactattgtcctcatcacttagaaggaatcggggagtataaacaagattgtgattgtcgtaagcctaaaaatggcatgctactgcaagcaataaaagaattaaacattgatcctgcaagatcttttatggtgggagataagaaagaagaccttttggcggggaaaagtgcggggataaaaaagaatattttggtcagaagcggtaaagaaatcaccgatgacggattgtctttggctgattatgtgttggatactattgctgatttacctgaattaataaaaaaattaaaattttaaccgcactttttattaaaaaattaggctatgtcttaaaataagattgaatgatgaaattcagttttttgcgttctgtttgcataattgcttattctgtacatacaaaaagagataacatttctgctatctctaattcctaaaatcatattttttagtttctacctacaagctgttttgttgcttcaattttcttatctttccacataacaacatcttttataacaagtttttggacagcagaaataagaagttccatataggaaaagtctatttcgttattttttgttggcagtttaattatttgattatttattactttttcactaaaactatttgctccccaagaaaatgtactaaaggattttctcatagtagatattaaaaacatcgagtttatcttattaaatttatcatatctacattctaaaattttaattttatctccagtaaaatatggcttttcttgataaaacattgtcgcagtatcttgtccaaacgcaatagtattcccatgatttagtaattgttcatcttggtttagataaccttttataccattattagttgacattctaacaatataaggaaagccacaatttaaaatttcaaccttattagcatcaaatctctttttagaagattttacattaaaaatatcttgtattttaaataaattccaattattagatattaactcaaatttatctaaagcttctttttcctcactagacaattcataattgtctagtctgcttaccgttaggtaagcggagagttctcttatacgctcatcttcgagttcgcttataaagctctccataaattcaaaatctatcttgttatcttttgttggaagttggatcacaaaggattttatcatttcaacatttgaaccatctccccaacttaaattacttaatagattgttaaatacggcaacaaaaaattcacttattacctcattaaaaattttaaattttggaacaagaactttaactttatttccagtaaaatatttatttttttgataaaaaacggtaaatgtatcctgagcaaaagacaatgtattactaggatttaaaaattcttcactttctttaatgtatcctttaataccattttctcctgtttttctcacaacatatgggtaactatccaatacttgttcatcaaaaacctctatattgctagcatgaaatattttttttgatgaatttacatcaaacaaatccccaattctatactcgccccactgaacattttggagtttttcgttcagtgaggcatttatttttttaggcgttcattctccttatctgtatttttaagaagagtggatacttcccaagcaaggtaatcagctacagttttcttgaaatcttcaagagttggtcttgtatctatcggtgctgattgattccagtctgaaccatttaaagggtcaatatgaccttcgtaatattctttttctgtaaagatgtttaatttttgttttccaaaacgcacaaggtctactacttcttgatatctttcttttgctctgtcggtatctctaagatttacacttgctttttttctgttcgttcttgtgtatccatcgtttgaaaagtcgataaacttcacaacttcatctttttgatgagattcgcctactctaaatacataaatatttgtttgaacacttgattttccaacaaataaatcgatgggcattttaatacttgcaagtagtgtattttttgctagtatcttcttgttaagttcttttgcttttccacttcctgcagagttttgaatgatgattgctgcatagcccttgttcatcatagatagggctttttctacgaaaatcattccattgccctctgctgaataaggcggatttaacacaaaagcagtagctggaaatttctcatctgttttaccaaatccatatttaccgtcaaaatcatgtagcgagtctttatttaagatgtttgagctaccatctcccataagtatcatatttaaaatggcaagcatatagatgttggatagaacttctaagcctaaaagctgttctgcttttatctttagttgtttttgctctagctcaagtggtgatgtgatttttgcttttgcatctataatcatctcgttcattgcagcaacaagtagccccgcacttcccgttgcaaaatcccacacatagctgtctttatcaactcttgcaagttttactaaaaaagttgctacataagatggggttaaaacaacatcgtttagtttatcttgcgtaaagccgagccaagagtacatttcattaaaaagcttacctgtgaagtctgtagttaaacctattttgtagtaaatacctaggtcatcaacgattttagcaaatattctttttaattggctttctccgtttattggcttattaatattttctgataataatgtattttttagtgttcttacgataaggtcttgttttgtttttggtaggtttttcttttttaaaaacgcttctatttttctaacgataatttcgccgtctgtgtttccctcttctattgatgattttaggtcagacttttctagtggacttacccccccccggtattcctaatgttgccataatagaagctgacacaagatagactctgtcgttttcactaagccctttttcatttgcgtaaatatcattgtttagctttactaaacttgcatttatttctttttcacgtttttctttaagtgcttcaagctcttcagcagataaagaaagttcgtttactttttgaataaaatctgtaaagttttcttttcttaaaaatgaaaggtctgtgtattttcctacttcttgccctatcccaaaattatcttttgatacatagtaaacgccaatagagtgttctatttctccgttttcttttttatatcccgtaacaccgattgctattacatttgtgtagcttgtgtagtgaagtatggcattggcataatgaaccgctccatttacagcatagctattaatatttttgtaattaggctcgtttttacttgttctattgtcaactctaccgtcaatgtctaactttactaatttatctttatatcctttatattctatcagtattggataatagttaagtgcctcatcttgcaataaaagttttgcatccggtctatttccacccgttccgccactttttgatttatattcatcaagtgccttatctatttgtgcatttagactttcttgttctaatttataatctagcccataacttttaagccacccatttacaaggtcaactatgtttggttctatagattgcattttaaccattgtctattctcccttttcaacatattcatcatcaaaagaaaatccatcgttcggcgtgcagtcaaatgccttgaatattctctctaaatttttaagtgttatcggtttatttttcccatttttgccataatattggttgttaaatctgacattgttataacatcaattttccttaagcctgtcaatcgtattttagaatgcaaccaaaaattatcttaaaaacccttaataataaggactttgggtgagagagtttttaatgagaacgttgtactagcaagtgcattctggcgatattttgagcggtagattctagattttgtctgccttgagccaaaatttcaggcaaactgtctaattgacgaataatggggaatactgcatcaatgccatgctcatagactacttcataatcttcccgtaagcagcctgtaatggctataacaggtttatttgccagtttggcagtttttgctaccccaataggcgttttaccgtgaatagtttgtgaatctattctaccttctccggtaatgaccaaatcggcatccttgataatttctgctaaatttactgtatcaatgacaatctgtacaccggatttgagttgtacttgaggcaataatagcaatccaccacccataccgcctgcagcacccgatccgggacgctcagcaatccgttttccgcaatctcgttctacaatacggctaaaatgcagtagagcttggtccaattgttgcaccatttccggtgttgctcctttttgtggaccgaaagtagcagaagcacctttttcaccacataaaggattatttacgtcgcaagctacattaaattgaacttgtgtcaaacgttgatctaaatgtgcagtgtcgatatgagcgatttgttgcagagctagaccgcccaagccgatttcttttccttgagcgtctttgaatttgatacctaaggcttgtagcataccgacaccaccgtcattggttgcactgccaccgatacccaaaataatttggctcacccctagatccaaggcggcgttaattagttctcctgtaccatagcttgtggtgtagtaaggattgcgtttttctatcggcactaaatgtaaaccggaagccgccgccatttcaataattgcgatttttccatcacccgatatggcaaattcagcttgcgttttattacctagaggtgcggtaacctctacagaaatcagtttgccttgtagtgcatcggcaagagattggactgtgccttctcctccatctgccatgggaacttttacataatctgcattggggtagatttttttgaaaccattttcaatagcttgagccacttcaagtgcggttaaactttctttaaaagaatccggtgcaatgacaattttcattttagttctccttgatagtgattgattaaaataattgccatacaccaaaaatcagagtagagataattgtcatgatcaaacctactgcagtttcgtatgggattagttttaaccgctctttaatatccatattaacactaccgccggttgcatgaaagaaagaaccatgaggcatatgatcgaagacggttgcaccggcatgaatcattgctgccgctgcgataccgctgacgctcagttcaattaaagttgctccgaacacttgagacgctacagcggttcctgctgtagtggaagctgaggctaatgacattaatcccccggaaatcggtgctaatagataagaaggtagtccggacgcagttaacccttcaattaagagttcttttaattcggaattagcgattacaccggctaatgttccggtacctaacaacatcacagcaacaggtgccattttacctaatcctatcactgcatattgatttaagtaacgtgttttattcatgcaaattgtgcctacaataccgccaagaggcagtgcgattaaaggatcaatttttatgccgaataatgggcgaagggcaagtaaaataatagtaaagagcggtgcaataatcgctggcaagaattttggtaattcgccagtgatcccaacgatttctttttcacttacttttgagcctttattcattaggcttttggctagaaaataggtgatgattagaccaaaaacagcaggaatgatacccgctgtcatcactgaagttagagggatgttgaaggcatctgatgcagcgatagcatttgggttaggagacataatattacccgctttaccacccccaatcatggctaacaaaatagccattttggataaattgctacgttttgccaatgccagtgcaattggggcaactgtgatgactgcaacgtcaataaatacacctacagccgttaataacattgcggcaagaatgagtgccaacaatgatctggattcacccagtttttttacgatagtatcggcaatagtacttgccgcaccggattcaattaatacacctgccagcacaccagcggctaaaatcctcataacagcggtagtgataccttgtgccccgcctatcatcagcgtaactgtttggcttagatccgcacctccgattaaacctcccacaagtgcaccaataatcatgccataagcaggtgggacttttttcaaaatgagcacaattgcagtaaaaagggcaacaattgccccgagagcagttacagttatcatgatcgtttcctcatatattaataaaaaatcatgttgtgtattattgaatgtatgaggttaaaaaatcttcatatataaatacaaaaatacctgataaataggattattttttgtatatttatacaatttattggtttagcaatgtgcttaggtagagtgtaaatttttcatctatcttattgaaagacaagccggttattttctcaatcttgcttagacgataccttaatgtattgatatgaataaataattgttgtgaagtgagagcaagatcacaatttgaaaaaaaatactgttgcaatgttttttgtaacagatgattttcgtcttgttgatataaggtatcaataggttttaataactccttactttgccaagtactacgtaagttatctaataaggcaggcaatttatattgattaaagaaatagatggatttcttaggaaaataagtttccccataacgaagggtactaagtgcggtctgaaatgaaagtgaaatgttgcgattattttcaacttcggaaccgatagccactttcagcccttttaatcccgaaggtaatagataaggaggaaataatttctgtaatccttttgtaccaagtaaggcttgaagttcttcagccggttgtataagtgcgattttatcatgcgataagattgcgaagtggttaatcgattgttctaaatatccagcaagcttttgaagtttctctgctgtgggatgcaaaatttggataataatgaccgcacttttagtgtgtagcgttagtccgaaaaaagcactttgtttctcaatttctgcctcgttgagtttaccttttaataaacctagaataaactcttctttataacgtttatcccaacgttctttttctaacaaaaaatgttgttcaatcatcaattcggcagtcattttaaccatttcaccataggatcgaacagtgtcgggatctccggaaatacctacaacacctaaaatttctcccaaataactaatgggaagattaatacccggttgcacttcaaataaccatttttcagccaactcctgatttatttctatagtttggttgtgacgaatagagtatatggcaccaatatgtctttgttgcaaacggtgaggattacttgaggcaataataatgccggtttcattcattacattgatgggcttatgtagaacacggtttgttcgttgcacaatattttgagctaaagaaacgcttaatttcatgttcatagcaggacatttactgtaattatcaatagagtgactctcattttatgagaattttagacaaggtaaaagtataaaatttcagcaagtaaaaaatttttttaaaaaattacttgcattgaaatataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagaatactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagggaagaggaaaatgggagaaaaaaagtaataaggtgataacaaggtagtcataaaaagtagggtaatgaagcagagtgaagaggtgcggtaggaaaattgtttttttttctaccgctctttttttaggtaatttatttatcgtttgccttattcatacgtccggcaaacaatatctttttcttcacaaaacatctcactatgctgtgcttgacactgtctttgtacattaagtttagctcggcctctgttggtatgctcactgcgatattcttgagtaaatggttttaatgtacaaacatgaatagcatcaaaatcagtttgttccgaaacaccgatgaaaattggaactggaatggctgtttgatcttttgttgatgtcggtacaatgcaacttgttaataatatacacaaaccgattaaacaaaaacgcatatttttctcctaaaaataaccttaatttcaaattttaagacgattttattatactcaatttttacaagaatgttcagagaaatgacaaaacatatagttttactttttctccataaaaatgtaggcatgatgtaattgaaactaagttgtatctcgtgtttaattaacattcatgccgatatcgaaaacatataagcaatatttgcttcgtttgttacaaattatttttcaattcgtaatccataagatttaaatttctctaatacaatctccatttcttttggagttaacaatgggatttctaaacctgtcgctaaaagtttcatgtaccattgtgccaagacttcaacttcatgagcaagccatagtgctttatcaagatttttctctgcagcaattaaaccgtgatgtgctaataaaattgctttacattttttaataccttgttttacatgctcagctaattcatgtgtaccaaaagttgcataaggaacacaaggaatatgatcagcaccgcctacggcaatcatgtaatgaaaaggaggaatgggtttttctaaaatagagacagctgcacaattgattgaatgattatgtacaactgcatcaacatcaggacgtgcttcatacacagctagatggaaatgccattcactggaggggaatttgccttcttcatgtttgccatgtttatctacataaacaatgttgttttcagtcagcaattcatatggcatgcctgtaggagtaattaacataccgtctttatatctgacactgacgttacccgcagttccttggtttaaaccaagtcttgtcatttctaaacaggtgaagataattttttttgaaagtagtgatctatccatttttattgtccttctatttcacaggtgtaacaccttttttaataataatattgccgtattttgcagtttcaccggtaataactactgcataagcctgttttgctcgctcataaaaagcaaaacgatccattcttgctaatttaggcacattacctaccgcacttttaattgtttgaagatagctttgctccacagcgggatccaaactatccccttccactgcttgcatcataattaacggtgcctcagtataagtatcaaactcaaataaaggggtaatacctgtcagtaaagaattgatactaataccgtcagcacgaacaactttatgatgcaattgatgagctggaaaatgagcatcagataaaactaactcatctccatgtcccatttctgctaaaattttcaacaaatccggtgaaattgccggatgaatcccttttaacatatatcctcctgaagttttttataaaattccatatctgttgaaggctcaattcgtcggaatgtcggcttcattttttgctgtgcctcttcgacgtttgcaaaaacgcccgcaccggttaaagtaaacatagctgcacccaatactgtactctctgctatatcaataacatcaatagggcaacctaagacatcagcacgaatttggttccaaagtttatttttagatccaccgccaaccacaatcaaacgatccgcactaaaatttcccactttttgtaatacattcaagcctgcttttaaacggtaagccatgtattccaaacctgcacgataaatttcgccacgtttcgtatgcattgataaacctttgatttcacctgtttgttccattttgccgtcaaaatttcctacgagcttcacgccattggaaccggcaggtactgtttcgccctctgcgatcatagtttggtaatattgctctttggttacatcggaaaagaattgtttgcccaaccattcaatcacacccgaactaacccattgcactcccggattaaaagcatcaggcagactatcaaattctatggttaaaccatctctgacatattgccattgtgcttgagcttgctgtgttcttaccattaaaatttcccaagtacctgaacttaaaacaggttggttatatttggcaccggaaccgaaaatagcaaattgagtgtcatgtccacaggaaagtactgggatatgtgttgataaacctaaatattttgccacctcaggtaataaattacctattttttcacccgctcttttcatcggcgggaaatgttgttcgttcaaacctagaaaatctaaaacctctttatcccaagagtcattttctatatttgtcatcattgatgtacctgccatagtacgatctgtactaaattgacctgtcaaacgttgagttaatatagatgaaatgaatacccacttatccatctcggcaaaaatatccggtttattttctttcaaccacaataatttgaacaatgtattgaaactatattgtccaataccattacgctgatagagcttttttacatcaaggtattgatgaagtttctccatgacaggcaaagtgcggggacatttccaagaaattattggaaaaatttgcttcctatttttcgaaaaaggagcaccatctacaccaaaggtagtaataccaatccctttaatttcagctaaatcaatttgtttttggcgtagattcacaattgttttttctgcacaaaaaataagtttttggtagatttcttcgatgtcccaaatatgataaagagagttttcaggatcaggttgagtgtgattaggtgtatgatgtgatgcaacgattttacctgcttcatttattgcaatggtacgtaaatttgttgcaccacaatcaaaaatcaatgcaattgccataataactccataaaatcatgagcttattgcttaattaagaggggaaatttagtccttccccctccccttggatttcataaattaacgatataaaggaccaaagtttgcacaagcacggtaatcttgaccttctttatcttgaccaaatgcactccaagcacttggacggaaaatgtctttttcttcgacattgtgcatacagactggaatacgtagcatggaagcaagagtgatcaaatcagcaccaacatgtccataagttgcaacgcaatggtttgccccccaatttgccatgacagaataaacgtcagtaaatgctcctgtacccgttaaacgtggaacaaaccaagtagttggccatgtttgatcagtacgtttatttaaaatatcatgcacgttttctggtaaagcaatagaccatccttcggcgatttgtaaaacaggcccaatacctttgactaagttaattctatgtatggtaaatggcatcccgcctttagttaaaaattgtgacgataaaccgcctcctctgaaatattcgtgtaccgccggacaccaacgagtattttctaagcaacgctttccatcttcttttgttacttcccataccggtttaatgactgatgttccgtttggatctgtatgttgtcccgtgccatccaaagcggcagagccggaatttagtaaatgaataaatccactttcaggacgccaacctgttacacgctcaacagaatcttcactccaataggtacgtacatcagcaaaaatttgagcctgaccggttagcaaattgccgaataacatgttaacgccatttaatgaatcattttctgtggctaaaatataaggaggacgtacaccgttccagtcataagttgaattcaatattgcttccataaagtcgccgttcggtagatgatctgtccaatggcgttgaccttggaaaccagcactaatcgcattatgtcccattgattcttctacataaccaagttcagctaaacgaggattaccaaccattagatctcgacaaataatcgtcattttgacaacattttcccaaagttttgcacgttcttccgaactacgctgattttcttcagcatttacatcaataccttctttacagtattgagttacccattccattgctaatttaacttctttttcatcatagattttgcgatctaaacggcgtttaatttcggtcatatctacatattcattacgcatatccaaatattcttgaaagaatgcttgattaacgatagaaccggcaatacccatagaaactgaacctatagataagtaagatttaccacgtaaagtcgcaactgcgagaccggcacgagcaaaacgtagtaatttctctttaacatctgttggaattgttgtatcagatgcttcttgaacttcagtaccgtaaatagagaatgcaggtagccccatttggttatgtccggcaagagccgctgccaaatacaccgcaccgggacgttctgtaccgttaaagccccaaattgcttttggcatatgaggatccatatcaattgtttcagaaccatagcaccagcaaggggttacagtgatgactgcaccgacattttcacgtttgaatttttcagcacatgcagcagcttcagcgacaccaccaatcgtggtgtccgcaattacacatttcacaaattgcccatttgtgtgccgcacttccgtttcaattaattgagcaaccgcttttgccatattcatggtttgatcttctaaagattcacgaacgcccatacgacgtccatcaatagttggacggataccgatttttaccggtgttgattttaaatgtgtcattttttattccttcttgatgattaagtttattttttcacaaaaaacaacagaacatagttttttgtgtaatttgtaaaattttcgtgagataaatcacaaaaaaatccttttttgggttaaatttcttgtttttatttgcccgatttttaaatgattcatgatttttcgggcaaaacgatcaaatcaggcttcgaattatttcaataccttccaacttctataaccatatatagtaattggaataaaacagattaacggtagaacaaaagaaatgttgaccgccggcatatttaaaatttcgcctttgtcgatgatcatgccttgcaaaggtggcattaatgcaccgcctacgattgccataaccagacctgcggcaccaagacttgcctcttcttttaatccgtataaagcaataccgtagatagttgggaacataagtgacataaagcctgaggttaaaattaagcaatataagcctaatacaccgttgataaaaattacgcctaaaatgcttaagaaaccgccgaccccaaataggcataacatcaactcagcttttaaatacttcatcatactggtgctgataaagcgactggtaacaaaaattatcattgcaataatattaaagttttgggcttcagctttagtaaaacctaaacgctcggcatattgaatgatgaatgtccagcacataatttgaacacccacatagaaaacctgagcaattacaccttcacgatactttgcattttggattaggcgagaaaatgcgtctttgaatgcaattcttccccccccccctagctcttccatttttgtagtaggcattttgtataaactaatgactaacatgatgattaaaacaacacctccaacagctaaataaggattacgaataatttctaaatcatgggtgcgtatagtcgctttttctgcggtagataaggtattaaaaattagatttcccattgcatcacgtttttcagattctaggctggttaatactacttgtgatgccacaaacatacctgtaatcgaacccaacgggttaaaagattgtgctaaatttaaacggcgggttgcagtttgcggatctcccatcgaaagaatatatgggttggctgtggtttctaaaaaagctaacccaaaagtcagaatataaagtgatagtaagaaaaaagtaaattcttcatacaaagctgccggatagaataagaatgcaccaactgcataaagggctaaacctaataagacaccggatttataattaaatcggctgacaaaaagtgcggctggaattgccattgttccatagcctccataaaaggcaaattgaacaagagcagcttctgatgctggaatttccataacagtttggaaaacggctaccattggattcgtaatatcatttgcaaatccccacaaagcaaacaaactggtaattaatataaaaggtgcaataaattgcttttcaagagttttagctgtcatttttctttccttaattatgagagtagtttcaaggattacattctcgtaaaattatgctgcgtgctttgcatcattttttgaaagaatgttaaaactattagaaaggaaaaatagaaagacaataagaaatttatgaaagtagttaaatttctgtgaaattcatcacaaaaaacgctaaaaaaattaaaagataatgcccgaattaaatcaattcttttgtaaatcgggcattattttgtttggataaagaggatttaaacaatagtgattaaaacatcagatttttggcagtatgatgtcaaagttggatttggaacttggtctgtaaataaaatatctatttgtgataaatctgttaaacgaatcaaatttctacgttcaaacttagaactgtctaataagagaaatttctgttcacaagcatccattaatttacgtttaattgaggcattaagctcatttgattcccaaactccaccgctactatcaatgccggtgcaagagaaaatcccaatatcaatatgtaaacgttgtaataattgttcggataacggtccataaaaagcatcatatttcactgaataaacgccacccgttgcaatggttttaatattaggtttattaacaagtgcggtaatgttatgcatagaattggtcactactgtgcaaggaatattggggatcatttgtgcaaaatgccagctggttgaactggcatccaaaccaagtacaataccttcaaacatatattcaatggcggaagcggctatggcacgttttttatcgcaattaaagcgttgtcggctttgaaaagaactcccgacatctttcgctttacggctgacagcacctccatgtacacgatgaattaaccctctcttatccaaatcggttagatctcttcgaatagtttccacagatacgtcaaattgtttagctaaatcatttacattcacttttccggatgaatttattaattgcaaaatcaatgtttctcttgatgacatttcttttctccaagcagtcaagatggttacgaaagattacacgctaaacgatagtaagatcaactgttgaaaaattaccgcactttgccttaaatttattttactgtcattggtagtgttaatatgttcaagaagaattgcgtcagatcaggaaaagctgacttttcactttaaaatatactcattttttgctataaagtcggcagttttttacttaatacttaggagatattttatggagttagtatttattcgccatggttttagtgagtggaatgccaaaaacttgtttaccggctggcgtgatgtgaatttaacagaacgtggtattgaagaagctaaagcagcaggtaaaaaattacttgaagctggttatgaatttgatattgcatttacctcagttttaactcgggcaattaaaacctgcaatatcgtgttagaagaatctaaccaattatggattcctcaagtgaagcactggcgtttaaatgagcgtcattacggtgctttacaagggttggataaaaaagcaactgctgaacagtatggtgatgaacaagttcacatttggcgtcgttcttatgatgtttctccaccggatttagatccgcaagatccgaattctgcacataacgaccgccgttatgctcttttacctaaagacgttgtgccaaatgctgagaacttaaaaatcactcttgaacgtgttctgccattttgggaagatcaaattgcacccgcacttctttctggtaaacgtgtacttgtcactgcacacggtaactctttacgtgcattagcaaaacacattatcggtatttctgatgaagaaattatggcttttgaaattccaactggccagccgttagtgttaaaactggatgaacagttaaattttgttgagaaattctatctataatttctttatatacctaatcaatggctgagggcatctcagcctttttgtatcactttttacattgatttgattttatcttgtcgcaattcctctttaatttctgtacaattggcagattttgtgtttattgagatattctatgagttcatccccaaatattggctttatcagccttggttgccccaaaaatttagttgattctgagcgtattctgacagagttacgttcagatggttataatattatttccagttatgaaggggcagatttagttattgtcaatacctgtggctttattgatagtgcggtgcaggaatcattggaatctatcggagaagctttagagaataacggtaaagtgattgtgactggttgtttaggggcgaaagagaaccaaattcgtgaaattcatccgcaggtgctggagatcacaggtccgcatagctatgaagccgtgatgaaacatgtgcataaatatgtacctaaacctgaatacagtccttatactagtcttgtgccgaaacaagggataaaactgacgccaaaacattatgcttatttaaaaatttcggaaggttgtgatcatcgttgtactttttgtatcatcccttctatgcgaggtgatttagatagccgttccattgtgcatatactcgatgaagccaaacgccttgtagatgctggtgtgaaagagattttggtagtatctcaagatacctctgcttatgccttggataagaagaaagaaaatgccagtaaaacggtattctggaatgggatgccgattaaaaatgatctgattactttatgtgaaaaattaggttcgctcggtgcgtgggtgcggttgcattatgtttatccttatccgcacgtagacaatctcattccattgatggcagaaggtaaaatcttgccttatttggatatccccttacaacatgccagtcctaaaattttaaagatgatgaaacgtccgggttcaattgaacgtactttagagcgtatcaaaaaatggcgtgaaatttgtcctgatttaactttgcgttctacctttattgttggttttccgggagaaacggaggaagatttccagttattattggatttcttgcaagaagcacaacttgatcgtgttggttgttttaaattcagtcctgttgaaggtgcggtcgccaccgatatggaagatcaaataccggaagaaatcaaagaggaacggtttcaccgttttatgcagttgcaacaaaaaatttccgctgaacgtttacggcaaaaaattggtagaacattatctgtcattattgatgagattgacgaagaaggcattattggtcgtacgatggcagatgcaccggaaattgatggcgttgtttacgtagataatttttcaaaagtggaagtaaaactcggacaaattattaatgtaactattaccaacgcagatgaatatgatttatggggagagatttaagtgcagttaagtgcgggttgaattaccggaatatttattctccctcagaagcagtgatatattataaaattcaatttccaggatatgtatcatgttatttttacgacaaaaattcaaaaatagattaaaacttaccgcacttttttatgtagtttatttgcttttttcgtttgttgctcgtgccaatgaacttactcgcctccaagaaaaaattaagttacaagaacaaaaaattgcacaacaaaaaaatgaacaaaatgaattacaaaacgtattaaaaaaccaagaaaataaaattagtcaagcggaagataaattacgtcaaacagaagaaaatttgaaagaaacacaacaacttatcaatacaacagataaacagataaaacgcttggaaatgcagctcaaaagtcaaaaaaaactgcttgcagagcaaatagataaaatgtaccgagctgagattaattcttccgcagttgaaaagttgttttctcaagaggcacaaaaatctgaacgtatgcagatttattatcgtcagatgaatcaaactcgtgtaaagttgattaatgaaatccaacaaactcaagaacagctggagaatgaaaaagcccttattcaaggaaaaagaaaaaatcagcaaaatcagctgacaacacaaaaacaacaacgacaagaactacaaaaattacagcgtgagcaacaattaatgcttgaacagctgaatcaaaatttagtaaaagatcaaaataagttggagcaattaaaggcaaatgaaattgccttgcgtcaacaaattcagcgagcggagaaaattactaaagagaaggaacagcgagagcgggcagcattggcacggaaaaaagagtcggaagaaaggaaaaaccgaaaaccttataaaccgacagcacaagaaaagcaacttatggcaagtaaaaaaggtttaggtgttgcaaaaaaacagtattcttttcctgtacagggtaaagttgtacaaggtttcggtacaagtcaaatgggagaattgaaatggaagggtatggtaatttctgcggtaaaaggttctccagtaaaagtaattgcagatggacgggttattttagtcagtcgtcttgcaggttatggtttaatggtaatcgttaaacatggagagcatgatctcaccctgtacggttacaatcaatctgctatggttgaagaaggacaatttgtgaaagccggacaaaaaattgctgaggttggtgatacggggagttatgcacttccggcactttattttgagattcgtcgtaaagggatacctgttaacccgatgggttgggtaaaataaaatgagaagaaatatatgtattaaaagtgcggttaaaatcagtcttatggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgctaaacaacgtgatcaacaggcaaaacaacaaaacagagatattttaattcatttacctatgcaaccgcttaatcagcaaaaaattgaagatggcggaataaaattaggtatgtcgcagccggaagtttatcagcgagtcagaaatgctaaaagtattttacctaacgctataggtatgaataatcacatgggaagtgcggcgacagccgataaagatttaatgaacaaattaatgaccgcacttttgcaacaaaatttattctttcttgatagccgaaccattgggcgatcagttgcggggaaaatagcgagagagtttggtatacccactttggaacgtcatatttttcttgatgatagtgataaacttagtgatgttcaacgccaatggaatgccgccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataacagaaaatacatgattgaagaataaacctctgaaggattttcagaggttggaagttaagggcgaatgtctcgtaagataggattttgcatagaaattaatgtttctgtagattgaatttcatcaattaattgaatttttgtagcaagaactgaatgaagttctgcaatagtatgggtcatgactttaatgaagatagaatagttaccggtcgtatagtatgcttcaactacttcattgatattctctaattgcttgataactttgtcgtaatctttagcactttttaaaataataccgataaagcaacatacatcataacctaatttacgttcatcaatgcggatttttgtgccttgaatgatgccggattgacgcattttttctactcgcacatggatagtgccgggactgacaccgaaatttttcgccatttctgcataaggtgtacgtgcatctttgattaatactcgtaagatttgttgatctaattggtctaaatttggcatatttatttttccttattattcagaattagaaaatatataaaaatattatgctatttttaatataaattcaatattaataaaaaaataaataaatggtattgaattagtggtatgttttattaaataatacctaacgtgaatttaatattcaattactcgttattaattattaggatgtatgtcatgaaaaaatcatttattttacaacaacaagaaattagttttgctaaaaacacttttacagaaaaattaatcgaacatttaggcatcattgaagttcaaggacctatcttaagtcaagtgggaaatggtattcaagataatctttcaggtacagagaaagcggttcaagtaaatgtgaaacagatcactgatgccaaatttgaagtggtgcattcattggcaaaatggaaacgtcatacattagctcgttttaactttgcagagaatgaaggcttatttgtacatatgaaagcattacgtcccgatgaagatagtctggatcaaacccactctgtttatgttgatcaatgggattgggaaaaagttattccaacaggacgtcgcaaccttgcttatttaaaagaaactgtacgttcaatttatcaagctattttggaaacggaagatgcagtacaccaaaaatttgggttgagtaaatttttacctagagagattacttttatacacagtgaggaacttgttcaacgttatcctgaattgaacgataaacaacgtgaaaatgcgatttgtaaagaatatggtgcagtattcttaatgggaattgggggagtattatcagatggcaaaccacatgataagcgtgcacctgattatgatgactggacaacaccgtctgaaggtgagtatttaggtttgaatggtgatattcttgtttggaatcctgtattggagcgtgcatttgaagtatcttctatgggcattcgtgtagatgaaaccgcattacgtaaacaactggcattaactggtgatgaagatcggttgcaatttgactggcatcaagatcttgtcaacggacgtttaccgctttctattggtggtgggattggtcaatctcgcttggcgatgttgcttttacagaaaaaacatattggcgaagtgcaatcaagtgtttggccaaaagttgttacagaacagtttgaaaacattctgtagcgtgcttttgaatattatattgaaaaagtgcggtaaaaataccgcacttttttatattaacgctggtgtattcttgatagaatgagcactcacttatgcttaataaaatataatttatgtataactcattttcttctttatttgaacaagttttgcagtctcccgattttatcattttaataaaaatgtctgttgctatgctattgggtggagcaattggcttggaacgagaattgaagcataaaccagttggtgtaaaaacttgtgtgattattgcggttacaacttgtattctgaccattgtgtcaattaaagctgcggaacattatgcacaagtttcagaaaatatccgaacggatccaatgaggttagcggcacaagtcattagtggcatcgggtttctaggtgcgggggtaattttacgtaaaagtaacgatgctatttcaggattgacaactgctgctattatttgggcagctgctggtattggtattgttgctggagccggcttcttttttgatgcttcagttgctacatttatgattttaatcgcagttcgggtaggtccgacgttacaacaaattatccgtcgcagtacacgtagaacacgtaaaactaaaatttatattcaacttagttcaccattgatcatcagtaacgttacggatattttaattaataataattaccgaattgatagtttatctgtcaaagatttacaaaatggagaagtgcgtttaaccattagaggattaatcacagataaatcgaaagtacaaggcgtttatttgttactaaaagatgaagaaggcgttgtcagtattgatttggctaattaaaagaaaaatccagatatttaattgatttgctccaaaagttgtactacatacgccatcaacaaattaaggggtagattttttatgatcaaagggaatagctccttaaaatttttacggtattatgtagcagttgcacaaagacctaaattcattaaaaaaaaccgcttagaaatgaaatgccctaaactgatttttcagcctagggcatttgttatgacatattgtggctaatacggaaaactcacatcattgttatgctggtgatatttttgccaaaatgcgtgatattgttttttcaccgatgtgtttaataaaaacgggattatcaatacataggtcgggcaattccatagcattgcacgttgtgtatccgtgccgattttggtgcgtaagtaaccaaactgatacattagacccaatccaatcgttatccactctaatagcataataaataaagtcgcatcagtgagtgaaaccagtatcttatggtgtggtagccattgataaagtagcacgcccactactagcattattacggatagcataaaagtatgcctcacctttaactggtgacactggcagcagacagcacaaaaagctagagcatataacatcatcaaagaataaaataaaatcattgttaaccccccctttaatgtgtgttcatcatcgctttttgacctataaaagccctatctaaccaatacttatcgacttcattagagatgataggactctcaaatacttccattactgaatcaatatcctgaatctttttctgtacctgaaagtgagcgtaagccaaactaaagtaaggggttggctcaatttctttattctcgcccttttcatcgtaaggctgatgtaacaacatatcatttgaatcatcttgggattcaagtgattgaggtaatgtatcccacgaaatgccctcttcattcattactttcaacgctatcctatcggctaaggtaggttgattttctaataagcaggtaatcgggtcattggtatcataatcaaaacgaatgccatgaacatcaatcggtgtgatggttttcatcattataagatttcctttgtgttgagggtgattaaacagcaatgtgatagtctgctgcattttcgcttaaactggctattccaaaggtagcaggcggtcttttattgccttgccaataaccgacaaaatgccgtgagggcggacagcttaggcgtttgttgagtaattgggtaaatttttctttctcgcttttacggcgttcatcttcccgccaagcggtttcattcgcatagtgcatcatatagcggttgctgattcggtgatgaacccctgtcatcattcgcctaaatcgagcgaaaaacgattcgacaaggttgttggtgatgccgtctattgagcagtattcttgtgagtgattcactcgttctaaccgataatgaatgttgagcaggccataggcggcattttcatctgcacaaattacgctgttggctttcactaagtgatgcgtgagagcaagaatatcattgccattttcttccttaatcattgccacaatacttttatctgcacctttcattatggattgattggtggctcgttgacggaaaacgattacacacgccttgtctttacgttgattgcgtttggctcgtctatctatccgtctatgtttaaaattctttgggcgaatgtagtaattcacatagcagccatctgaatgtatctcacctgataagggagttaaatctttagtgagattgaacgactctcgcaatttatgtagcaatacccaagccgttttatattgcacattgagtttgtgagaaagcgaaatagccgataagcctgtgctttctgtggcaaacaaatacagagctatcaaaatctgacgtaatgagagtttatgaaattggaaaattgtgcctgtcgtaatcgaaaaacgagtgtggcaatgcttacattgccattgttggcgagtgttagtgaagtaggcggaatgacggacaccgcaatgaggacaaacttgttcatcttccgttccccagcgggcttttttgagtagagcctgtatttctgcatcagcaagcccaaccacttgtgtcagtgacaagtggcgagcgttcgcagataacaggaaatgctgtgccataaaaacaaaaatccctttattgccactctcaattttccaagcctttttagacttaaaaacaatcaaaagttgtaataaagggactattattcgtgccaaaaatgataatagtaacaggggtattgtcaagtgatactttcaagcaaaaattcaaaagtctgtcaagttatttttgatggaatataaaaaataaatttaaattattgatattaaattactattttgtgaaaaataatagagatttggggatttttgtgtgtttaattgatgattttttgttcaatctgattttcaaaggttgtatgattattgagctattttgagtgattaggtggctaattctgaggggtatcttgctaaatatttaaggacaacgatagtaccgtttaccatcaataacaagcagattttggtttactaaatctttggtatagaaatgatagtaagcgaaatgattctgcggcataattcgagattcatttattttaaggatttaaaatgttcttgacactatttgctttacaattaacattgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcgttgcaacagaatagatctttacaaaaattcgttcaaagaattttttcaactttttgtatgggagtaaaatcctatgcagtctaatcaactctctttatttggtacgcaaccaaaaccaaaaatcctttctcttttttcaggctgtggaggtttggatcttggctttcaccaagctggttacgaaacagtttgggcgaacgacttttctcattgggcatgcgaaagtttccgtaaaaatatcggtgatgtaattgtagaaggtgatattgaacagattaacccaaatgatcctacgattcccgactgcgatattattcttggtggttttccgtgccaagacttttcgatgatttggaaacagcctggcctagatggcgagcgaggcaatctttacaagagctttttacgctttgtgaatgccaaaaaaccgaaagtgtttgtagcagaaaatgtgaaaggtttgctgacagcaaataagaaaaaagccattcaacaaattattactgattttgaaagctgcggttattacgttcaagctaagttgtataactttgccgaatttggcgtaccacaatttcgtgaacgtgtgctgattgtcggcgtacgtttagatactggctttaattttcaacacccaatgccaactcataatgcaagaggtgaaaatgggctaaaaccttacgttaccgcaggtcaagctgtttctaatattccaaacgatgcgatgaacaatgagctgatgaaaattagcgataaaactcgtcaaatgctgtcacttattcccgaggggggtaattttaccgatattccgaaagatcatcctttgtatgtgaaaggaatgattagccacgtttaccgccgtatgcatagagatgaaccatcaaaaaccattattgcagctggcggtggtggcacttggggctatcattttcctgagcctcgagcctttactaatcgtgaacgtgccagattgcaaagtttccctgatgattttgaatttattggctcagctactgaagttcgccgtcaaattggcaatgctgttccaccgcaaggcgtagtagagcttgcaaaagcaattttgcctattttctcggataattatgaaaaagtagatttacacgaaaaattggaaatagaaaaaacagaagtcttccaaaaccgtttaaataaaattcgtggaggaaaataatgaacaccgttttttctaatatcgccaatgcacgtattaccccaaaatctttaaataaagtttggacagatttatttatgtcgtctgatgaagtcctgatgacgactggttatgtttcaaatgatgcagtaaaagaattacacaaaattttggaacataatcaatctattcaaactgttaagctattggttggaatgcactatttagaaggttttagtcagcttcaatatgatagcttgtgtgaacttaatcaatttttgcagcaagaacagcgtggtgcggtttatgtttctccttttgttaaatttcacggcaaaatgtattcattcaaaaatagaaatgaaatacaaggtttaattggttcagcaaatttaacgtgtttttgggataaaacagaaagaacctatgaaactatgtttcatcttgaaaaactacctgcgatctcattaagaacagatattcaaacgacaatttctaaattggggaaacacttagaagaagctaaacgccccgatcattttagagatcataatattaatttagctcaatgtttaggtgtacaaaaggtctcgcctgaacatttggtttcttattttgaaaaaacatctcaatataaatttgaaattcctgcaaaaactgaacctaaaagtaatttaaatgtattctttggcgatccaagagtgggtagaaaagttttgccaagaccctggtatgaagtagaacttattattcctgcgacaattgttcggcaagagggttatccaacgaacagaaaaattcaagtgattaccgatgacggttggttatttccttgttattcaaaaccaaaaaataaaggtgaaaaattatcaacggaaaacttccgttccgaaaacgatctaaaaaccttaggaaaatggattaaaggaagattagaaagtgccaactgtttaaaaacaggcgaaaagatcactgaagaaactctacgaaaatacggtaatgatcattttgaatttcgttcaacggataatcccgatatttggttactttcatttaaggggaaaaactaaatgctgcaaacctatttaaatcaacttacaccacctgaattagctgattctataaaaaacaccgtttccggatttatggataaattggctcaaattgagctaaagaaagcccaaaatgttttattattaggcaatgtacaaagtggtaaaacagcccaagttttaggtgtattaagtgcattggctgacgatggcgatcataaaattttcctttatctgactactgatagtgtcgatttacagcagcaaaccgtaaaacgagctaaagcaagtttggataaatttatcgtcttatcagaagatgatgacaaaagttttactcaagtaatgaaagcagataatccgattttagtagttatcaagaaaaatgctagtgtgttaagacgttggcgaaacttatttaaaagccaagaaaatttaaaaggctaccctctagtgattgtggacgacgaagctgatgcggcaagcctcaatactaatgtaaataaacatgacaaagatgctagtacagtcaataaattattaaatgaaatcaaaaatagctgttgtcaaagtttatttattcaattaacggcaacgccacaatccttattgttgcagcacttggagtctaattggcagcctgattttattcatttctttgaaccaggtgagaaatatattggcggaaattttgttttttccgatccaccaagttatattttccgagcgattgacagcgaattagatgagattaaagatgatagtagcgatattccttatggtgttaaacaggcgttacaatcatttatgattacttgtgcagaatttgatttatgcaataaaactaactgtaattttgcattacacccaagttataaaatccaagatcataaagcatttgcagataaaattaaatcttgtttaaatgagttagtatacgccgtaaataatgatgaaaattttgcaaatagttttaaagaaagctatcaagatttacagaaaactaaacccaatattcatcactttgaagaaatctacgaaaacctgaccgcacttttgcaaaataaacgaattaatgttgttgtgctaaattctaaaactgaatctgattttgatttagaaaaagagtttaatatcgtgattggcggtaatgtgattgggcgtggtttaactattccaaaactgcaaacagtttattatagtcgtacagccaaaaagccaaatgcagatactttttggcagcattctcgcatttttggttatgatcgtgatacatctctgttaaggctttatatgccaacggatgtatataaattttttgtatcgcttaatcaagcaaataatttaattattgaacaagccaagcaattaaacggcaatgtacaaattatttatccgaaaaatatcaacccaacacgtaaaaatgtgttgaaatcagatgcaatcaatcaacttgttggcggtgtaaattattttccatttaagccaaatgaaaaaaatttagcccaaatcaacggattactttctgctattgagcaaaatccaattaaggaagatttatatcaaattgacagtgaaaccttatttttaattttagaaaacctaggtaattatcaatctgatgattgggataaagaaaaatttattaccagtattcaagccttaaaaactcaacgcccaagttttaataattatgttttaatcaaaaagggaagaaaaattggtagagctactggtacaatgctttctgaagatgatcgtaaattaggtgataaatatccaaacgatttgtttttaacactttaccttgtagttggtgatgaaaataaaggttggaaaggcaaagatttttggttgcctaacatcaaattgccacataaaggtttagtttattggggattaaaataacattatgccatctgaatgcaaattcagatggctttttactatattaaacattatcgatttttgaaatttctttaaaagaaatcgaaaaagcttctttgaggttttcaggcattgcacggtaggtatgcgatgagcttttcctcttgattagacatattttcttgggagatggtttggaacatcgtcccattcccagtcagtaaccaagtaatacttattccgaatgcttgacgaattttcaacaatgcttcaacattcggatctcgtccctcattaagataattcattgcagagcgatacgagattcccgtcacatttgagaactccgtcacagtcatatttttagcttcaagaacctgctttaaacgatttgatatgcacattatttcacatttctcttgttaaaagtgaatgattgtgatactttgtgcacaatcaatatgaatgatgtttcatattctagtttaatcaaggtttaactgcaatctcttatgtctcaacattttcttctttccagcaaagcccgcacgcttcgtcattacagatagcccgcctatctgatgacgaagggtttgcgatgctgtgtgaaattcattggggaagtcaggaaaatgtgtgctgcccgaaatgtggcgtacaacataaagcctattttattgccagccgtaagcagtggcgatgcaagcattgtaaccatacattcagcattacatcaggcacgatttttgctaatcgcaagaagtcgttacaaacctatctctacatcattgccaaattcgttaatgtcgccaaaggcatttcttcattacaactggcccgtgatgcgggagtcaattaccgcacggcgtttgttttgtcgcataaaatccgcaaagccttattagatacacgtgatttacagcccatatcagggggaagtcgatatggacagctcttatgtttaccccgctcctcgtaaagaaaataagaaatctgaccgcttggattatcgtttgaaagccaatcaacaccctgataaacgttgtgtgattgtcgctcgtgagcattattcggtaaaagtgtgagagtgtactgcattgcggagcaaaacgttcactggtaatggtggcaaaatccgaaacggagcctgtcgtcaatacgtttgcgaaccgctttattcaagccaatagccgtatcaataccgatgaaagctctgcctacgatgtgttattgccacgttacgatttacgcacggtcaatcacaaggaagaataccgtagcgatttagggataacaaataaccaagcggaaagcctgttcagtcgctttaagcgaatgtattacggacaagtgcataaaatgagtaatgcttatctgctcaattatgcgaatgaagtggcttaccgtgaggataaccgcagaaagccgaatggttggcagtttaatgatatcttagataaatgtttacataccactaatgaaaacaatgagtggtgtggttgttggcaacgcaaaatcgtgcatcaagaggtattgtggcaataatggcaaaatcggtctgcattaatcaaattgaacgtaaaatccgcttattcgagcgtgaacgtgagcaagttgtaaagcatttagcccttgtggacgataagctacaaaagctccgacacgcccttgaggtattagaacatcgccattccgccgataaatacaataccgcctattttacctataaattacatcaacgccatttcaaaggtaagctgcggaagatgttaatcgaagtattaaggcaagaaccaaaccgctattttaccgtgagcgaattgattagcttagtgctaattaaggacggtcaagcagatacccctatcacagctcaacataccgtatcaatgcgtggggcgttaaagcattggttggataaaggcgttgtagaacgccttgaaaagaatgtggtagaagtacgttggaagctgaaacaagaatagcgacatctgtctctattttgcttttaaccgccaatggcatttttcctcaatccaacctttctcaaccaatcctttctccattaaataccgcaataccgtataaaccgtttgggtttgtgggtttggcaaggtgtgtcctatcttttgtccgtctaatttcatcgctcggtgggtaatctcattcgtgttgagccatttatcaggctgtgatttcagtatattggcaactaatttttgtggggaagtaataaaacgagcatttctctctttcttaccagtggaaaatggcgtatttttggtatggttaagggcggtacgataatcagcgagtttttggtaaatatcttttaactgctgttcaagtaaggcgattttcttttcaagctcttcaccctcttgttctcattcagcaatcgctgctatcaaggtttttgataaaatagcctgagagtgtttcattgcgttttccttacctttaggttataacagataagaaaaatgtagcagaaacaaaaaggaaaatctttgtgcaactgctacataataccgaaattttatccttttcacttgagctttatttttaatctctgtataatcgccaaccttacagccatagttaattttcgttccttgcttccgcaagattggtggctggtcttataatcggaggctgattaacccgtaaggagcagtaatgcgtcactacgaaatcgtatttatggttcatccggaccaaagcgaacaagtacccggtatgattgaacgttatacaggttctgttaaagaagctggcggtcaaatccatcgcctagaagattggggtcgtcgccaattagcttacccaatcaataaattacacaaagcacattatgtgctaatgaatgtagaagcgcctcaagaagtcatcgacgagctagaaacaactttccgttacaacgacgcagttcttcgtaacgtaattattcgtactaagcacgccgtaacagaagcgtccccaatggttaaagcacgtgaagagcgtaagcctttaactgaagttgaaaacaacgattttgaggatgctgaagagtaatttagaggttgataatcgtttttcgttaattggcaaagttgctgattttccaaaacgaaacaaaagcccaagtggaattgatcattgccttttctatttggaacatcgttcaaataaaaaagaagcaggttttacccgtcaagcatggtgtaaaatagccatccaaattagtggcaatcaattaatagagaaaactcaaagcattacggtcggtcagcaattattagttgtaggttttgttacttcgcatagaagttcaaatggtttaaatcaattaatattgcatgccgagcaaatcgaatttatagagtaggagactagccaaatggcacgttatttccgtcgtcgtaagttctgccgttttacagcggaaaatgtagtagaaatcgattataaagatattgctacattgaagaactatatcacagagagcggcaaaattgttccaagccgtattaccggtactcgtgcgaagtatcaacgtcaattagctcgtgctatcaaacgtgctcgctatttagcgttacttccatacactgacaatcatcagtaatttaaggagaatacggtaatgcaagtaattcttttagataaaattgctcatctcggtaacgtaggtgatcaagttagcgttaaagcaggttttgctcgtaacttcttaattccacaaggtaaagcagttatggcaactcaagctaatattgaatattttgaaagtcgtcgtgctgaattagaacgtaaagcagcagaagttctagctacagcacaagctcgtgctaatcagttagcagaattggcaactgttactattacatctaaagccggtgatgaaggtcgtttattcggttctatcaccgcacgtgatgtggctgaagcagtaactgcggcaggtgttgaaatcgctaaaagtgaagttcgcctttcaacaggaccacttcgcacaaccggcgaacaccaagtccgtttccaattacacggcgaagtatttgcaacattaaatgttgttattgttgcagagtaatcattaaaattataatgacagaacccaacttttatgttgggtttttttatatctttgttgccccaagtaatcttatagctaaattctttaactcatacattaatccacgtatttttctaacataacattattcatttctattttttatcctttatcctttatcctttatcctttgacaaccttagtagctttaattcaattataataacgcgctgttttcttactaactctttgagaaatagtaatctccgataattcctgtaatgatcatgggcttattgtaatctctgctgttgtgtatgggatattttaaaatctaaataatccgatacggtgtgccgtttcttttttgagtataatctgtcaatcttcttttactaaaggagattattgatgagtaaatcaaaagtagtattaatccgatatatatggtgctacaataagtgcggtgcatggtgcatggtgcatggtgcatggtgcatggtgcatggtgcatgctttgatataatatattttgagtgaggaatttgcgatgtcctatttagaacgtgcaagagagctttttgatgaagcaaaagcagtgagaagacaaatccatcaacaccctgaagtgggttttgagttgcccgataccatggcgttgattaagaaaaaattggacgaacataatattcagtatcgtcaattggacgatgcctatgctctagtggggacgttgggcgatccgagcaagggtaagacgttgttgttgcgtgcggatatggacggcttgccgatggtcgaagaagcaaatttggaatttgccgccaaaaatcaatgtgcacatttgtgcggtcatgatattcatgcgacaagtttattggttgccctgatcatgctcaaagaagatgaagataagttgcaagggcaaatcaaatttttattccaacctgccgaagaaacgctgaatggtggtaagttgatgatcgaaaaaggggtgttggaaaacccaaaaccggatgctggtctagcactccatatgtggcctaatggtgaaaaaccagggattttgataaataaagaagctgcattggcatctgcattgaattttaaaatcgagattaagggcaaaggggcacacggtgcgatgccttataacggtgtcgatcctgtgtttgtggcttcgcaaattattaacggcgccaacggtattttggcacgtgagttgccgtccagcaaaggggcttctttatccataggatcgatcagtgcaccgggcggggcaatcaatattgtgcctcctaatgcgtatttggaaggaacttcccgctcgttatacgatgattcggctaaacacatggcaaaacgattgcctgaaattgtcgagcatatcggtaaggcattcagagccgagacagtctatgaggaagtagcgaatgtgcctgcgttggtcaatacgcctaccatgtctgagttggtcaaggcgtcggcagaagaagcattaggttctgaatatacggtgaaatatattgatcctattttagcgtccgaagactatgcccatatcgccagtcaattgcctgaatcctgctatttctttgtgtcttgcccgcaaccggatgcggacggcaatgtctatgcggtacaccaccctaaagtggtcttcaatgaagaggcattgattatcggccctgcaactatggcacaagctgcggtgaactggttagcaagtcatcgttaagggggtgactcaatgagccagtgtggtgtgtattgaaatatcaatcccattggcttttttgtttttgaattaaaaatatttcattcaaagttttccgtcaatatccgctttgggatcccttgccatttaaaaaattaacccaagcggttttttttgcataaacagaaaaaagttgtagcaattattacatcaatatagacttgttccgattttaactcattgatattttagttaatctaaaaatttatggaaataaaatagccatgaaaacactcagtcaagccgctaaagtagtcacttttttacggcaaaatccacaacaaaaattcaccgctcgccaaattgccaaagcgattactgcgcaatatccgcacgattatcaagagaaaaaagccaactttacggatgaagggaaatttatgcaacaaattgtggcggaaattggttcacaaaaagatgccattttaaaacgttgccccgacattcaaatgcaggataaaccgcgtccgcgcttattttggtatgaaacaggaaattcaacaaaaggtgctttttctgaaaacacttttgttcaagtcaacgataaaaaaatctctgaacatgatgtgtatcctcaactcatgcaatttttatcacaagaattgaacttgtactgtttacggattgatgaaaaacgctctaaaaacaatcgtggccacaaaggtaatcaatggctacaccctgatattgtcgctatgcaagccttggataaacaatggacacaagatattcaagattgtgctaaattgggttcagggaaaaatgtggtattgtggtcgtttgaagtaaaatgcgaattaaacggtggaaatgtgcgtgaaagttttttccaagcggtcagcaattccagttgggcaaatgaaggctatttggtgaccaccgccattgttggtgaacacaccgaggaagaattgcggattttgtcggcattacacggcattggtgtgataattttgaatttagacgatttaaacgaaagcgaaattttattgcctgccaaacgcaaaaccgaaatagattggcaatctgctaatcgcattgtggaacaaaatacggattttaacaagtttattgaatacgttgccatttattataaaacaggcaaaattgttaaagagagttggaataaataaaacatgattaccaaacacaaccttcccgaattattaaaccatctcggttttaccgaacagaatcaaatctaccgcaaagtttttcatgggcaatatgaattaagcgtggatttcaaagcagaaaaaatccattatcccaatggtttaaccgccgaacgcgacaccacgctcaatttcagccagcctgaaaatttcgtggtgttggaatgcgtgtgccacttattgcaaacgagttacacgcccaatcaaatcgttttagagccgaaaatgacaggcggacgcgaagacaccagtttttattgcgatattttattgcgcgataacgaccacacgccctatatgttgattgaatgcaaaaccaccgacaacagcaacagcgaatttgaaaaagcatggcgcaaaatgcaaaaagacggtggtcaattgttcaattatttcaacagctaccgcaaagcacaatatttatgcttgtatgcttctgactggaatggcgaaaacgtagaacatagctaccgccttgtttccatgaaagacaacaccgaatatttaaaaagcgatgaaaaattgattggttatgagcaaattcacgcagaaagtggcagcaaaagcgatttctttgaagtttggaaaaacacttaccaactggacgcaacagaacatcaattatttgaatctgcaccatttaatatcggcacacgccccttttcagccagcgatttgaaagtggtggataacaccagcattcagaaaaaataccaccaattcgccaccattatgcgccaacacaatgtttcggggcgcgaaaatgcgtttgataaattggtgaatttgtttctcgccaaaatcaaagacgaaagcgaaaacccaaatgaattaaaagtttattggaaaggcgcggcacaagataattattttgacctgcaagaccgcctgcaagcactttacaaaaaaggcatggacgaatttttgggcgaagaaattacccacgttaccaaagaagaaattgaagccgcctttatcttattcaaaaacaaaaaagacgaaaccaagaaaaccattttggacaaattcaccgaaatcaaatattacaccaacaacgatttcgcctttttggacgtacataataaaaaactgtttttccaaaacggtgcaattttaaaagaagtggtacagatgctacaggacattcgcctaaaaaccgacaatggcggcgaaaatcaatttttgggcgatttgtttgaaggtttcctagaccaaggcgtgaagcagtcggaagggcaatttttcacgcctttgccgattgtgcgttttttggtgtcgtctttgcctttggcagatttgatttcaggcagcgatgcaccgccgaaaatgattgactatgcttgcggtgcggggcatttcttgaatgaatacgccagccaaattcgcccattggttcaagcatttaaacaagcggacaccgcaccttattatcaagccatcgtcggcattgaaaaagaataccgcctctccaaagtggcgaaagtttccgcgtttatgtatgggcaagacggcattcagattgtctatggcgatggtttgactgcacacaacgataaagtgaaagtggaaaatggtgcgttttcggtgctggtcgccaatccgccgtacagcgtgaaaggttttttggacacgctttcagacgatgagtgcaaatctttttcgctttacaaacatgtggataaaaccgatacctttaattccattgaaacttttttcattgaacgcaccgcacaattgctccaacaaaatggcgtggcggcgattattttgccgtcttctgtgttgagcaatggcaacatttacatcaaagcacgcgaaattttattgcaacactttgatattgtggcgattgccgaatttggttcaggcacattcggcaaaacaggcaccaataccgtaaccctgtttttgcgtcgcaaatcagacgcacccagcttgtccgcacattaccaaaaccgcgtggatttttggtttagcaatgacaagtccgccgatgaattgttccaagacgcacatttattgcagcaatattgccaacattgcggtttaaattggcaagattatcaagactttttgactttcaggctgcctgaaagcggtattttcgccgattaccgcgaaacttatcgccaaagcactgattggaaacaacgtcaagccaaacgcgattacaaagcactttccgatacggaaaaagcagatttgtttgaacaaagcgcgtgggcgtttgcgcgtgaaatggaaaaagacaaattgcattattttttattggcttatgccaatccgcagcctgtactcatcatcaaaagccccgccgacaacaaagaagcgaaaaaattcttgggctatgaatggagcacacgcaaaggcagcgaaggcatcaaatacatcggcagtagcgaagcggaaaacgaagaaaaccccaaccgcaatcaaggcattttcaaaatgcacacgccacttttcaatccgaatgatttgcatgactctagcaaactcaatcacttaatccgccaaaattttcaggccgcctgcacgcaaacgcagcctgaaatcagcgaagatttgcgcccatttgccagcttgcgtcctttgcatgaaatgctggatttttcgcgcacggtgtttgataaagccattcagacggcattggtggagaaggtggaaattcggagtaagtatccattggaaatcattggtaaaattgcgccacatattgaaagcggaaaacgtcctagtggtggcgtaggctttatttcatcgggcgcatattcactgggtggagaacacattcataaagacaatggacatttggaattaaaaaatatcaaatttgtaccattgacttttttccatgaagcagaaaaaggaaaaatccaaaaaggtgatattttattgtgtaaagatggtgctttaactggaaaagtggcattggtacgcgatgaattgaatgatatttttgcaatggttaatgaacatgttttcgttattcgttgcagccagcctgaaacccaacaatatttattccatgttttacattcggcaatggggcaaaaattattaaaagccaatacaacaggtgcagcacaaggcggacttaattcaagtaatttgaaaaatatccgtattcccctaccaccattagccattcagcaacaaatcattgccgaatgccaaaaaattgaccaagaatacgaaaccagccgtatggcgattgaaacctatcgtgccaaaattgcccaaatattcagcgatttagaagtgctggcacaaaattcatctaggggggggtaaaactgtttaaaatcaaagatttatgcaaaacaaatccttcaaaaaatattttgagggatttgcctgatgacttgattgtttcttttgtggaaatggcatcggtcagcaatgatggttacattcaacaaaaaattaaccgtccattgggcgaattgcgtaaaagcagctacacctatttccaagaaaatgacatcattattgccaaaataacgccttgcatggaaaacggtaaatgtgcattagcaacagaattgagcaatcacattggcatgggtagctcagaatttcatgttatccgctcccaatcaccaacattgaataatgcttttttattccattttttaaatcggaatgaaattcgtcaatcagcagaacaacatatgactggggctagcggtcatcgccgtgtaccaatcgggttttatgaaagtttgccagttcccgtgccaagtattgagaaacaaactgaaatcctcgcccaaatcgcgcaatacgaagcccaaatcgccacttgcgagcaaaaaatccaatctttgcccgctcaaaaacaggcaattttggtgcagtatttgcagtgatgtaactttcagacaacctgaaaaataaaggcaggtaaatatccgaaaacgacttaattctttacacgaccacagacattcaagcccaatttttgttatacgaattgggcgggtaattgtggctaacgcaagcagaaattgccgaactggtcaaattaagaaaaaaacggcaaccctacctcatttcttcctgaaagtgcggtgttttttagcgataaaaatcatttcgttgattaaaaacttttcatgaagacaaaatatgtgattttttaaatgaaaaaatcgctatttgcaatgccgtttattgaatcaaatggttacatatcaatgctatcgttttttttgtttttgaatgtgaaataatgaagcgataatttgatttaatttatgtattgttatttaatatgcctatccgttggtaacggcgattattttattaagcatgacattacgcttgctgtctacactgtcaataaaacacgtttatgtgatggtctggggagtattttatgtcttgtttttgtgtgttgttgtaatctgtatatgagttttttttggagtatctataatggaaccatcctaccaggaacaaaacaattgtactgaaacgattaaaatcaatgaagtcaaaaaactttggttggacagtaaattttcccttaatttacctgtatggacattgttgttgcctttatttgcattattagtattggcatttcatttgctgacttacccaacaggctggttgattaatactgttactacggttttgcttatcggttcggtatttgctgcagtgcattatgctgaagtgattgctcataaggtgggggagccgtttggtacgttggtgcttgcaatagcggtaaccgttattgaagtggcattaattgtgatcctgatgagtaacagcacgcaggaaaattctttggtgttggcaagagatacagtttatgcggcattaatgttgatttgtaatgggatcgtgggtatcgggctgctgataggcggtatgaaaaattatgtccaattatttagcttgcacggtattaaggctgctgtcagtgttttactggcaatttcattaattgtttttgtgttgcctaattttacgctttctgccgagggtggtggaatggtcaattcacagctgttgtttgtggcaatgtgctgtttggtactttacggctctttcatttttacgcaaactattcgccatcgtaattattttgttgatgaggatgaaaatgaaagccatcacaacgacaattggttaacaattggtgtgagtattgtgtttttattgataagtttagtttctgtggtaggactggctaaaatgctatcgcctactattgagtctgcactagttagtttcgggttgcctaaaataatgttggggattatcgttgccggtttggtattgttgccggaatcaattgcttcaattaaggctgcctataataaccagttgcaaaacagtctgaatcttggtttgggttcggcattagcgtctatcgctttaactgtgcctgtgattgcgattatttctgttatctccggccagcctattgtgtttggtttaacagccaaagaaagtttgatgctgattattacacttttattgacaatgaatactttaagcacaggacgtagcaactttttgttgggagttattcatttggtaatgttggcaacttttattttcttttccatcattccttgattttgaaatgaatgatttacatcagtaagtacgaagagaaaatcaatcacattattatcgggtagaaatatatgaaaaatagaaatttttattttggattgggttttattgctttgcttaccattatcgtgagttggttggcaaatactcaatttgcacatcaagcgaaaatcagtgctttgactatcgcaattttgttaggcattttaattggtaataccttttatcccgcactttcatcaaaactggacaaaggcgtgttatttgccaagggaacattgctacgtattggaattatattatatggcttccgtttgactttgcaggacattagccatgtgggaatcaatgccattgttacagacagtgttatgttgctttccacttttttccttgccattgggataggaatttattggcttaaaatggacaagcagacggtgtatttgacggctggaggctgtagcatttgtggggcggcggctgtgatggcaatggaacctgttaccaaagccgaatctcataaagtatccgttgctgttgcggtcgttgttatttttggcacgattgccatgtttctatatccgtttgcctattcttatttacaacattggctaacagatcatcaatttgggatttatattggttcaacggtacatgaagtagcacaagtttatgctgccggcggtaatattggtcctacggttgctgatacagcagtaatcaccaaaatgattagagtaatgatgttagcaccatttttattagttttatcttgggcattatcaaaacagaaatcagataaaagtaaaattaatattccttggtttgctttcttatttattctcatggcaatctttaattcctttgatattttgccaaaaagtgcggttaaatttattgtaaaattagacgatttactgttaattgccgcaatgatagctttaggattaaccactcatattagtgctatcaagaaagcgggtgtaaaacctttattattagggatgttactctttatttggttggttttaggaggattagcagtgaatttgttaatgcaaggatttttataaagataaggatattattttgaacaatcttactgaaacgtttactctcgaacctcaagataatgcacgcttacaatccctttgtggcacatttgatgagcatttgcaattaattgaaagcagttttaatttggttgtttcacgccgtaattttacttttactgtacaatccgcagacggagaagaaaaaaacacgtatcatccaactttgctaaaaagtgcggtgaaattaattaaaaatttatatgctgacactgcaaaaattcgtggcaaagtgaaagagctggatttggaagatatacatttggcaattcaagagagccgaatgttattacaagataatactcaaacaaagcgggaagatagtaaagtttatagcacaacaattaaaactaaacgtggcttaatcaaacctcgtggtaaaaaccaaattgaatatttacataatattctcacacacgatattagttttggtattggaccggctggaacagggaaaacttttttagccgttgccgcagcggttgaagcattagagcgtcaagaagtgcgtcgtattttgcttacacgtcctgctgttgaagccggtgaaaaattgggttttttacccggtgatttaggacagaaaattgaaccttatttacgtccgctttatgatgctttatttgaaatgttagggtttgagcgtgtgcaaaaattaatagaacgtaatgtaattgaaattgcaccgttagcttatatgcggggacgaacgttaaacgacagttttattattttagatgaaagtcaaaacacaacggttgaacaaatgaaaatgtttttaacccgaattggatttaattctaaggttgttgtaaccggtgatgttacgcaaattgacttacctcgtagtcaaaaatccggtcttcgccatgcgattgaagtattagaaaatgtgccagaattaagttttaactattttgacagcaaagatattgtacgtcatcctgttgtggcaaaagttgttcaagcttatgaggtttgggaaattaaagatgagtttcgtcgccaacaattagccgagcaaaaacaacaagagcggttagaaaaagagcagtttaccgaagaacgggtaaaagcgttacaagaataattttatacaaaggttcaattcatgaaaaatgtcattattgacctacagatagcgagcgaagatgcgaccaatttaccaagtgtggaacaaattcaactatgggcaaatgcggcaattcgagcggaaaactcacaacctgaaatgacagtacgcattgttgatgaagaagaaagtcaccatttgaatttaacctatcgtggtaaagataagccgactaatgtgctttcttttccttttgaatgtcctgatgaaattgaattaccattaattggtgatctagtgatttgtcgtcaagtagtagaacgagaggcgacagagcaagaaaaaccactaatggcacattgggcacatatgatcgtacatggtagtttacatttgttaggctatgatcatattgaagatgatgaggcggaagaaatggaaaggttagaaacggaaattatgctttcgttaggttttactgatccttatattattgagaaataaccaacctgaaatgatatcttctcgccatgtgcaaattagtattgcacccaatctgcaaggttttggaccgcactttttatcacattttgatgttttgtggttagggtgggaaaaacccgattttaatgtgcatttttgccatgtgcaaaaagcaaaaaagttacttgggcaagagtttttaaatgtgatttttgatgctcgtcagggatttcatttagaaagtttggcgattgtggcgggaacgataaaagcaggtggaacattaaatattctacttaatcattgggatcttttagaacaacaggctgatgttgatagcttgcgttggagcggtgtagaagaaatgattgcaacaccgcactttattcggcattttcaacggattgttaatcaatttcagtttcctgttaatcatttcgctattccagcgattactcaaaataacctatctgatttattttgttcagttcaattgagtgcaactaaagcacagcaaaaagttattgacagtattttacagcaacaggcagatatttattttttaacagcaaaacgtggacgaggcaaatcagcattattgggtttgttatctcaacaagtaaaacagaaagtttatttgacggcaccgaataaaagtgcggtgaatattttgcaaaagttcgccggtcaatcagttatttttattgcacctgatgagtttgttcaccgtttggtagaaaatccgcaagaatatcaacatgcttggctatttgtagatgaagcagccatgctacctgtcagtaccttaaatttttttagtgcttattttaaacatattgtttttagtacaaccattcatagttacgaaggtacggggcgtggttttggcttaaaatttaagcaacgaattttacaacaacggcgaaaatgtcttgaatttgaattaaaggagccattgcgttggcgtgaggatgacaagttagaaccttttattgatgtgcttttattgcttaatagcgaagatgattttcggcaatatcattacaaatccaatttggacgttcacataaaatcgctaaatcaacaggcgttattgacacaaatagcagatttttacggtctattatctttagcacattaccgcacttctcctattgatttacgtcgtttattggatgctccaaaacaacgattttatttggcacagacagaaggacatttgctcggtggaatatgggcattagaggaggggggattgacagatcgaggattgattgcggcgatttgtcgaggagaacgccgaccgaaagggaatttagcagcacaattattggcttttcaatatcttaattcacaggcttgtgaattacgttctttacgaatttctcgcattgcacttcaacctaattggcagagaaggggagtagggcgagatttgatagctgctttgaaagtagaaagtaacattgattttttatcagtgagctttggttacagctcggagttggtttctttttggcataagtgcggttttaatttagtgtatttgagtgagtataaagaaagtagcagtggcacatataatgcaatggctatttgtcctttgactttgcgaggcaaagaattttcacaacaatgtatgagtcaatttagacgagattttgttttatcggatcatcctttattgaatgagattataaataatcaaactattgaggtagagttaaatgcctttgatgtatactcattgcaaaattttgcattttattaccgcactttatcggctgctcgtcctgccttatggagactattgaagatgatagctccctctgattgtcctgtcttgaggaaatatttttgtggtgaaaaagatttcttgtcttatggcggttatcgacaaggagtgataatttgccgcaacgaagtaaaagaagtgttgcaaaaatataaaaactttctatgatggagtgatttttatacaggaaggagaatgtgatgccggatcaatcagaaaagaaaggttttttccgccgtatgctggatgcgtacaatcaattttgtaatgaaatggaggtggataaagggacttgtcgaggctgtgtacctatagtcaaatttgatgaaaatgcaaaacaagaaacagataatgaggctggtaaagcatcataattgtgaagtacttcacataatggaaaagatttagccaaccaatgtatccatcttagtttacttaactataacaactctctaaaatacgcacgctttacttcagtgaagttggcgtatttttattattatttttaggtgattattatgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccgattttcggaccgattatgggggcattatatggaccggtggcgatgttatggattgtactgggttgtgtatttgccggtgcagtacatgattatttctgtggtatgttgagcgttcgtaatggtggtgcttcaatgcctactcttgccggacgctatttaggtactcccgttaaagtatttattaacgtacttgccgttgttttattattccttgtcgggattgtgtttgtaaccagtcctgctcagttattaagtactattactttagatatgtttggtagtgcaagtatggctacaaccaatgcacatgaggtggtaagtgcggtacaaaacgctggtgagatccgtgtttggggaatggataaaccgacagttgtggcggtttggactggaattattttcctttactatattgtggcgacattgttaccgattgataagattattggacgtatttatccattatttggtggattattattattcatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggttacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcatttattagtgcggtatgttttacatacttagcctataacaaaattggttttggtttagattatcaactttccgtttatattggtattggattaactattttgtgtttagtggctttctttattttattgaaaccgttaggttcgaaagatccggatgcctttataaatgatgtagcataatttataaacaatagataaaaaaccgtttaaggcaacttgaacggtttttttataaaaaatttactttatttatatgttttcaagataaaaaacttgcaacctaacttgacagataatacacttattaagtggtaaaaagtggaattttgtggagaaatttgtcataatcttcctaatttatctgcgatgaataattttttgtgattaaagtaaggaaacaatatgtttcgaggtgcatcagcggttaatcttgattctaaggggaggattgcaattcctactcgctatcgtccggaaatcctcgaaataaatcaggggcagatggtttgtaccgttgatattcgccagccttgcttattactttaccctttaaaccaatgggaaattattgagcagaaattatcgaaattgtcgaatttcaatccggaagagcgtagtttgcaacgtgtaatgctaggttatgcaactgaatgtgaacttgacagtgccggacgaattcttattagtgctcctttacgtcaacatgcaaaattagaaaaatccattatgttggtggggcaattaaataaatttgaaatttggagcgagtcagagtggcaagctcaaattgaaaaagatatgacattaggtgcgagtggacaatttgccatgtctgaagcattaagtatgttatccctataataaaaaagatacgttacagtcagtaacggtactagcaaaggtaaaaaggtacgttttttgttgtaccttttatcccttttgattttattgatttttcctaggttattgcaaatgagtatgcaagatacattttcttcacctgagcatttcactgttttattaagagaagcagttggcggtttagccttaaaagaaaatggtatctatattgatgggactttcggtcgaggcggtcattctcgttttatcctttctcaactgtcaaaaaagggtcaattaattgcgattgatcgtgatccccaagcaattcaggttgcacaaaatattcaagatccacgttttcgtattgtgcatgacagcttttcagctattccggatatttgtgaaaaattaggattgacgggcaaaattgacgggattttacttgatcttggcgtgtcatctccacaacttgataatgcggaaaggggattcagtttcatgaaagatggtcctttggatatgcgtatggatacgacacaaggattatcggcaacggaatggttgaggcaggtttctgaacaggatttagcatgggtattgaaaactttcggtgaagaacgctttgccaaacgtatagctcaggcgattgtaggatataacaaaagtgcggtgcaaagtggagcagaacctttaaacagaactttacaattagctgaactgattgctcagtctgtaccttttaaagataagtataagcatcctgcaacgagaagtttccaagctattcgtatttttattaattccgaattagatgaattagaaaaagtattgaatggagctttaaatgttctcgctcctcaaggacgtctgtcgattatcagctttcattctctagaagatcgtatggtaaagcattttatacgtaagcaaagtaaaggtgatgatttgcccaaaggattgccattgcgtgaagagcaaattcaacataatcaaaaattaaaacctgttggtaaagcgattatgccgacagaacaagaaatggctgctaatgtccgttcaagaagtgcggtcttacgcattgcggagagaatataatggtaagagatttcgaacgctacccattgtataaagttatttttgaggacttggtttctgcaaataaattattaattgttttaacgattttggttgtattgagtgcgttaagtacagtttggattactcatcaaactcgtattttagttgctaaaaaaagtaatttagttgttgaaaatcaatcacttgagcaagaatatttaaatttaagattagaggaaaaggcccatagtcttcattccgatatagagtcttttgcctctcaaaagttgaagatgaaatccgttccggctgaacaagaggttgttatcattgaatagataatagatattaggcggttattaatgacacataataagataaatcgaaaaaacaaacgagcatttgaaaatggtgcaaagcgtaatcaacctaaaaagatctatgaaaatagtttcttgaaatggcgttttatggttgttgttggtcttattattttatcactcacagctttagtgggacgtgctacttatgtacagatgattaaatccgatgtgctatctaatgaggcggatgaacgatccttgcgtaaagaaaaaattttgtctatgcgaggtaccattgttgatcgcaatgggcaacttttatcagtgagtgttcctatgttttcaatttcagctgaaccaaaaaaaatttttagtaaaaatggtttacaagatgaggaacgctggcgtgcattagctaaagcattaggtatgtcttacaaggacttacgaaaaattctagaaaaaaatcctaaatctggttttgtctatttagctcgtcaggtgtcaccaaccattgcggagtatgttaaagaattaaatctatatggagttaacttaaaaactgaacctcgtcgtttttatcctaagacagaggaaactgcacatttactcggctataccaatatagacggggaaggtattgaggggatagagaaaagttttaattcatttttagttggtaaacctggatcaagaacagttcgcaaggataggtatggtaggattattgagaatatatcagatcttaagaaatacgatccgcaaaatgtcattttaagtattgatgaaaaattacagtccgtagcttatcgtgaaataaagaaagctgttgaaaaatacaaagcggaatcaggaacggcagtacttgttgatattcatacgggagaggtgttggctatggctaatgcaccttcttataatccaaatatacgcacaagttttaagactgaagtgatgcgtaatagagctattacagatactttcgagccaggttcgactattaaaccttttgttattttgaccgcacttgaaaaaaaagtagtgcgaagagatgagataatcgacactggtcgtttagttttagatgggtatgaagttaaagatgttgcagtcagagatcgccaaacgcttgatcaaattttagaaaattcgagtaatagaggggtgagccgtttggctttgcgtatgcctgcaaatgcactaatagatacatataaaaaagcaggtttagggcaacgaacagaattaggtttagttggggaacaggcaggtttcttgaatgccgatcgtaagaaatggtcagatattgatagagccagtgtttcctttggttatggcatcagcactacgccgttacaacttgctcgtgcctatgttaccttgggcagtttcggtatttatagacctctttcaattacaaaagtagatcctcctgttattgggcagcgagtgttttctgaaaaaatgactcgtgaagtggttaatatgatggagaaagttgcgataaaaaataaaagagcaatggtagagggttatcgagtgggaataaaaacaggaacagcaaagaaaattgaaaatgggaaatatgttaacaaatatattgcttatacagccggacttgctccaatcagcaaccctcgctatgccttagtggtattaattaatgatcctaaaggtagagaatattatggtggggttgtttctgcccctgtattttccaatattatgagttatgctttgaaagcaaataatattcctcctgatagtagtaactatacaaaaactgttagacgtacagtttatctcaatagtcaagagaataaagcgaaagccaattaatcattcaggtaatctatgaaaaaattaaccgcactttgggatattgatgaacaattagatagcgttcatagagatattgaacttcaagaaatgattttagacagccgtttagctaagaccggctgtctttttgttgcgattaaaggacatcgtgttgacggtcgagaatttattatgcaagccattcaaaatggagcaagtgcggtgctgtttgaaactgatctagtggagcagcatttgacagtaagctttgagcaaaatattccgcttattgcgtattatgaactgtcaaaacatctttctcatattgcagatagattttattcatctccttcacaacgtttaacccttgttggtgtaacgggaaccaatggtaaaacaaccatagctcagttacttgcacagtggacacaaattttagggcatacaagtgcggtcatggggacgattggtaatggtttatttgggcaaataaaagaagcttcaaatacaacgggatcggcaatagaaatacaatcctcgttagataaatttattcggcaaggtgctgattttgctgcgattgaagtgtcttctcacgggttagtgcagcatagagttgaggcactgacttttcgtgcaggcatttttaccaacctaagccgtgatcatcttgattatcatcataccatggaaaattacgcacaagcgaagaaacgtttgtttagtgaactgaattgtcaacataaaattttaaatgttgatgatgaaatcggggcaacatggttgattgaattaagtaaagatgatcctgatgtggttgcagtaagttgccgtgcggattatcagcccgatacaaaaaattggctaaaagcaaccgcacttagttttcacagcaaaggcacaacgattgaatttgcctcaagctggggaaatgggatcttaagtagtccattaattgggggcttcaatgtgagtaatttattacttgttttagccacactcttatcgcttgggtatgacatagataaattacttgctacagtacggcaattaaccggtgtttgcgggcgaatggaaatgttgagtgcaaaacataaggctaccgtgattgttgattatgcacatacaccggacgctttagagaacgctttgcaatctgctgcagttcattgtcagggaaaactttggtgtattttcggttgtggcggtgatcgtgatagaggtaaacgtccattaatggcagctattgccgaaaaatttgctgatagtgtgattgttactgatgataatcctcgaacagagaatcctgaacaaattatgcaagatattttgacaggttttcagcaatcaagtgcggtgcagattattcatcagcgtgagcaagcaattaaaacagcgttacaaagtgcggtagaaaatgatgttgttttgattgctggaaaaggtcatgagaattatcaaattattggaacaactaaataccatttttcggatcaggaaattgtaaaaaagtatttttaagtttagtaaaatttgaagtcattgatgagtaaaatacagaaataattcattgtattgaatgatgagaagtaagaaataacatgattaagttatcgacaaaagaactggctgacattttttccgcacgattaattggagcgaaggatatttgtgtggaaaaggttagtaccgacacaagaaagccttgtttaagaagtttgttctttgctttgaaaggtgaaaattttgatgctcatgattatctgacacaggcagtagaacaaggttgttcagctgttgtagttgagcgtgagtgtgatgttgatgtaccacagttaattgtacctgatactcgtcttgctttagggcaattagctaaatggctaagagtaaaaattaatccaaaaacaatcgcaataacgggatcttcaggcaaaacaacggtcaaagaaatgacagcttctattttgcaaaaagtagtgcaagatcctgatgcggtgttatttactcaaggcaatttcaataatgatatcggtgttcctttgactttattgcgttttgaaccgaaacatcaatttgctgtcattgagttaggggcaaatcatcaaggcgaaattgcttatactgtggatttagtccaaccggacgtagcgttggttaataatgttgctgctgcccacttagaaggatttgggagtatcgaaggagtagcacaggcaaaaggtgaaatttatcaagggttgaatggcaaaggaattgccataatggaatatgagcattctgtactctggaaaaaatattggcatgaacagataggtgatgcagaaactcgattattttccactcaggggaagaaatcagactactatgcgcaagagatccgattaacggaaacgggatctcagtttaaattgtgttgtaccgagcatggggaaatagagattaatttaccttatttaggtttgcataatgtcagtaatgccgtagcggcagcctcattagctttatgcttaggtgtgagtttagaacaaatcaaagcaggcttagaaaaaaaatcgtatgtaaaagggcgtttatttcccattgagccttgtccaaatctattgttattagatgatacttataatgctaatgtaagttcattgaaatccgctattgatgtattgcgacaatatgataaatttttccgtatttttgctgtcggtgatatggcggaattggggggaaattcagtgagttgtcacaaacaagtagcggattttgctcagatggcgaacttagatttagtggtcagttttggtacacaaagtgcggtcatttccgatgcttgtgatggcgttcattttagtgataaaaccgagttggtgaattatataatccccattattcagcaaaaattagccagtcaaaaagttgttttattagtcaaaggagcgagatgtatgcaaatggaagacgtgattaatttagtaaaggataaatttcaatgttagtgtggttagctgaatatttacaccaatatcaaagtgtatttaatgttttttcttacttgacagtgcgtgcaattcttgcacttttcaccgcacttttactctcgctatggattggtcctaaagtgattcgtcgtttacaaattttgaaatttgggcaagagatacgtaatgatggtcctgatagtcacttaagcaaaaaaggcaccccaacgatgggaggtattatgattttatttgctataggggtcagtacgttattatgggcaaatttagccaatccttatgtttggttttgcttgtttgtattatttggctatggagcggtcggttttgttgatgattatcgtaaaattacacgcaaaaatactgccggtttagttgctcgttggaaatatttttggctttctgttatcgctttaatctctgctttcggtatgtatgcgataggtaaagatacggatgcgacacgtttggttgtgcctttttttaaagatgtcatgcctcagttaggtttgttttatattgtattggcatattttgttattgtgggcaccggcaatgcggttaatttgaccgatgggctggatggcttggccattatgccgacagtttttgttgctgctgcatttgcattgattgcatgggcgaccggaaatattgaatggtcaaaatatttatatattccctatattaaacatacctctgaattggttatattttgtactgcaattgtgggtgccggtttgggttttttatggttcaatacgtatcctgcacagctttttatgggggatgttggttcattagcattgggtggagtattaggtactattgccgttttagttcgacaagaatttttattggtgattatgggcggtgtatttgtcgttgaaactttatcggttattttgcaagtaggatcttataagttacgcaatggtaaacgtattttccgaatggcaccgatccatcaccattatgagctgaaaggttggccggaaccacgagtaattatccgcttttggattatttcgctgatgttagtgttactcggattaattaccttgaaattacgttaaggcaagctatgactaatcaatatcaaaacaaaaatatctgcgtagtcggattaggtaaaacaggattgtcttgcgttgatttcttgttacggcagcaagcaaatgtgcgtgtcattgatactcgtcaacaaccgacgggagcagaaaaattacctgaaaatgtccccttacatacaggaagcttaaaccaacaatggctacttgaagctgatctcattgtgattagccctgggctttctgttaaaacacttgaaattcagaccgcacttcaggccggtgtagaggttgtcggtgatattgaattattttgtcgttacgccaataagccaattattgctattacaggctcaaatggtaagagtaccgtgactacattggtcagtgaaatggcgaaagaggatggcttaaaagttggaatagggggaaatattggtattcctgcccttgagttattgcaacaagattatgatctctatgttttagagctatcaagttttcaactggagacgacttatagtttgaaagcgacagccgcaacgattttaaatattagtgaagatcatatggatcgttatctcgatattgaagattatcgccaagccaaattgagaatttatgaaaattgtcaacgtgcggtaataaatgccgaagatgtattaacaacaacggaagatttaaagtctccaattacttttggagaaagtcaggctgattattggctaaaaacggaaaatggcaagcaatatttaatggcaaaagagcggttaattttaccttgtgatgaaatgaaattggtaggtcgtcataattatatgaatgcgttggcggccagtgcgttggttcaggctgtcgacataagttttactgcaattcggaccgcacttcgtaaatttaccggtttagctcatcgctttcagttagcatatcagaaagatgatgtacgttggattaatgattcgaaggcaaccaatgttggaagtacagttgctgcactgaccggtttgtatgtagctaataaattacatttattgttggggggggatggtaaatccgcagatttttcggaattggcaacattaattaatcaaccccatatttattgctattgttttgggcaagatggtaaagaacttgccgcactatcagtgcaaagtcagttatttgatacgatggaacaggcaatagaagctattcgtccgaatttacagcaaggtgatatggtgcttttatcaccggcttgtgcaagtttggatcaatttaaatcctttgaacatcgaggtgatgtttttagtgatttagcgaagttggcacagggttaaagatagagacaaaatgggacaaaataacgtaaaacaacatattgatcgttggttgcgtattacaccaacaacagcattatatgatcgagcattgctatggttgtttattattctattgtgcttgggattaattagtgtatcttccgcatctattccaatcagtacaagattatttaatgaacctttttactttataaaacgtgatataggatatatttttatctcgttaattgcttttgcgtttgctgttctcataccaatgagaatgtggcaaaaatataacgttatattattttggattgctgtgattttattattgctggtgcttactggaatcggaaaagatgcaaacggtgcaaaacgttggattccgttacaactatttaattttcaaccggctgaatttgccaaattagcactaacgtgttatttggcagattatttcacacgccgttataatgatgtacgtagcaaaaaattaagtgcatttaagccattttttgtcatggctatattgggtggattattattgttacagcctgatttagggagtgcggttgttttatttgttataacttttggcttgctttttattgttggtgcaaatttttggcagtttgtagggctgggaggaatcgcttttttcttattcctatggttagtcgcatctgcctcttatcgtttaaaacgctttacaggttttcttgagccttttaaagatcctctaggagcaggttatcaattaacaaactctttaatggcttttgggcgaggtgagttatggggcgaaggattgggaaactctgtacaaaaattggaatatttgcctgaggcacataccgattttgtcatggcgattgtcggtgaggaatttgggcttgtgggcattattgtggtggtgttcttacttgcgttactcgtttttagagtaatgaaaatagggagagagtcattattattagaagaacgctttaaagggtttttggcttttggtataggtttttggatattttttcaaggatttgtaaatctcggtatggcattaggcatgttaccgaccaaaggattaacctttccattagtgagttatggcggttcaagcttgctgattatgtcagtcagtattgcaattttgttgcggatagattacgaaaatagagttgttcgagttggaagtgctcgactaagagatgattaaaataaggaaaataccgtgtcaaaaagaaaaaaattattggttatggctggcggaaccggaggtcatgttttccctgctattgctgttgcacaatatttacaaaagcaagattgggatatttgttggttaggcactcgggaccgtatggaagcaaagttggtgccaaagcacgggattccaattgagtttattcagatttccggtttaagaggcaagggattaataactttattgaaagcaccttttgtcattttaagagcggttctacaagcgagaaaaatcataaagaaatatcaaccggatgtagtactcggcatgggaggatatgtctctggacctggtggagttgccgcaaaactttgtaacatacctgtagttgtgcatgaacaaaatgctgtattaggtttaacgaattcattgctggctaaaattgcgacacgggtattacaagcatttccaaatacatttcctaacgcagaagtcgttggtaatccggtgcgtgaggcgtttttttctgtgcctatgccacaagaacgttttgacactgcttgtgagatactcaaagttttagtggttggaggaagtcaaggggctcatatattgaatacaatattaccggaagtattagctcaattgcctaatcgtctggaaattgttcaccaagtcggggctggttcggtggaaaacgtcaccgcactttatcatgataaagttaatcttacgcgagaatcagtacaaattaccgaatttattgatgatatagctcaggcttatgcttgggcggatatcgtcatctgccgttccggagcattgactgtctgtgaacttgcagctgttggtacaccggctatttttgtaccctttcaacataaagataaacaacaatatttaaatgcaaaatatttagctgatgttggagctgcctatattgttgaacaacatgaattggatgcagaaaaaatagctcaattattaaaaaatgtagataaagaaaaattactggaaatggcggaaaaagcaaaaaatatgtcgacgccgttatccactcaacgtgttgctgaagttataatggatactgttaaaacttagccaattaaaatgaaaagaacattttgctatgtaaatgaataaaggaatgatgaatgcaagcatttagacaacgaattagacaaactgtacctgaaatgcgtcgagtaaaacaaattcattttgttgggattggcggagccggtatgggaggaatagcggaagtgttattaaatgaaggttatcaagtaaccggttcagatattgcggaaaatgcggtaaccagtcgcttaatttctttgggagctaaaatttctttctctcatcatgcagcaaatattgagggtgctagcgttgtcgttgtttccagtgcgattaagggagataacattgaagttattacagcacatgaaaaacgtataccggttattcaacgtgcacaaatgctggcagaaattatgcgttttcgtcacggaattgctattgcgggaacgcatggtaaaacgactactacagcaatggttgcaatgatttatgcacaagccggtttagatcctacttttgttaacggcgggttggttaagtctgctggaacaaatgcgtatttaggatgcagtcgttatttaattgcagaagcagatgaaagcgatgcgtcctttttacatttgcagccaatggtgtcggtagtgaccaatattgagcctgaacatatggaaacttatcatggcgattttgaagaaatgaaacaaacttatgtgaatttcttgcgtaatttgccgttttatgggttatctgtgatgtgtgctgatgatcccgttttaatggaattatcctctcaagtaggacgccaagtggttacttacgggttcagtgatgaggcggactatcgcatagaagattatcaacaaacgggttttcaggggcattatacggttgtagcaccgaatggggagcgtattgatgtgttgttaaatgtgccaggtaaacataatgctttaaatgcaaccgccgcattaaccgttgctaaagaagaagggatcgaaaatgaggcgattctgaccgcacttgccgagtttcaaggtgccggtcgtcgttttgatcaattagggcaatttattcgtccaaatgggaaagtgatgttagttgatgattatggtcatcatcctactgaagttaacgtaaccattcaggcagctcgccaaggttgggagaataaacgtattgtgatgattttccaacctcatcgttattctcgtactcgagatttatttgatgattttgtacaggttttatcgcaagttgatgtgttaattatgctggatgtttatgcggcgggtgaacaggctatcgccggtgctgatagtcgctctttgtgtcgttcaatccgtaatttaggtaaagtagatccgattttagtctccgatcataagcaattagctgaaattgttgatcaggttattcaagatggtgatttaattttggcacaaggtgcgggtaatgtgagcaaactttctcgtgaattagcgttggcttggggtaaagaatagttattagctcttcggagttacaatgtaaaaaagtaggatataaaatggctaaaccattaaaacaacaaaagatcgctgtcttattaggggggacttcagctgaacgtgaagtgtcgttaaactcaggaaatgcggtcttaacagcgttacgtaatcagggttttgatgctcacccaatcgatccaaaagaatatccggttgctatgttgaaagaacagggctttgatcgagttttcaatattttacatgggcgtggcggtgaagatggtacgatacaaggattattagagcaaataggcttaccctatacgggttgtggcgtaatggcatctgctttaacaatggataaaatgcggactaaaatgttgtggaaagcattcgggttacctgttgcagatatggaagtcgttactcgcactagtttttcgcagttaaatccgcaagtagttgtagaaaaattgggcttgcctttaatggttaaaccttctttggaaggttcaagtgtcggattgacaaaagttaacgctattgatgatctaaaaagtgcggtggaatttgcacttcaatatgatgaaaccgtactgattgaagaatggctttccggtgatgaattaacggttccggtattaggtaacgaagttttaccttcgattaaaattgtaccccaaggggaattttatgattatgaagcaaaatatattgccgataatacgcagtatttttgcccctcaggattaacggaagagcgtgaacaagagcttcgtcaattagtcaaacaagcttatgatgttgtgggttgcaggggatggagccgtattgatgtcatgctggacggcgagggtaaattccgcttagtggaagtcaatacaaatccgggaatgacaagtcatagcttatttccaaaatcagctgcaactgttggttattctttcgagcaattggtcgtcaaaattttggagctaagtctttaaatgagaacaacgcataaagtaactgaaaatttgaaagtgacaaaacggaagtcctaccgatttgtcaacattaaatttattgttatgttgttattggttgcaatactgatttttattgttagtaatcgtcagtcgattttagaaaagttagatgatagctcaattaattcatttgctattgcaggtataacaaattttactgatgacaatgatgttcgtgaagttttgtctcgaatatcggacagcggtgagttaaaaggtttttttggacaagatattgatttggttaaacagcaaattgaaatgataccttgggttaaatctgtggcagtacgtaaaatttggcccaatcgcttaagtatttgggtaacggagcatttacccattgcacgttggaatgaaacagaatttttgtcatcagagggaataatatttcaattaccaattagtaaattaaaaatacaaggattacctcatttgtcaggacctgatcataaaagtgctgaggtactggaagcttggaataaaatttatcttgatttgaagagaaaaaatttgttgttaaaaaaaattgctatcaatgagcgtggttcatggcaaattgtgttagagaacgatgttgtattaaaattaggacgtggagaatggaaagataaattggatcgttttttcacaatttatccacagattgaaatacctgaaaataaaaagttatcttatgttgatttaagatatggtgttggtgctgctatcggtgtagtagattctgactaaatttaattttaaatatgtgaagtgactaaaatggctagaattgtagaagataagatatttgtaggtttagaagtaggaacctcaaaagttgttgctgtagtaggggaattattacccgatggcgttgtcaatgtattaggtgccggaagctgtccttctaaaggtattgataaggggagcattacagatttaaatgcggtcgtaacttctattcaacgagcaattgattcaaccgaagcggttgcagatagtcagatatttagtgtgacattggctattaccggtgagcatattcaaagtttgaatgaaaatggatttgtgcctattgctgaggaagaggtgactcaagaggaagttgaagcggcgttgcatacagcgagttcagtccgtattggagatgggctggcattattacatataattccccaagaatttgcagtggataagcaagtaaatataaaagatccactaggattgcaaggtgtgcgtttaagtgctcaagcacatttaatcgcttgtcatcaagattggctaaataatctgaaaaaagcggttgaacgttgtaaattaaaagtgaacaaagttgtttattccggatatgcttcatctcaagcggtgttgactgaagatgaaaaagaattaggtgtttgcttaattgattttggtgccggtacgatggatattgtggtttataccaatggttttattcgctttagtaaggttattccttatgcgggtaatcgagtgactgacgatattgcttatgcttgtgcgacttctaggacagaggcggaaagtattaaagttgcttatggaagtgcggtcagccctccattagatcctttagataaaaaaattgaagttgccagtatcggtgggagagcacctcgagtcatcagcaaagaacaactttcaattattacttctgctaggtatgcggaattacttggtgtagttaaatctgaattggatcaattgaaatatcaattagaaaataaacagataaaatttgaacttattgctggaattgttattactggtggcggagctcaaattgaaggattaagagaatgtgcaacgcaagtattcggttctcaagtgaggattggtgtcccacttaatattaccgggttaactgattatgtaaataaaccacaatattcaaccgtagttggtttattacatcatcataataatgattttgaggatattttatctgaaagtgatacagaaactgacggtgtcggcaaaaaattttggaatatttgtaagaaagttgtcaataaagtgcggtcagagttttgaaaatttgattttttaatctacaataggcagaatttaggttttaattttgtgctaaagtcgggaattagcatttacggagaagaaatatgattgaaccggttgattacgattacgatgatattagcggaggtgcactcatcaaagtcgttggcgttggtggcggtggcggtaatgctgttaaccatatggtggctaatatgattcaaaacgatattggcgggacgctacttggcgttgatgaattggcttatccaatgtcagatgataatcatggcaaaattattttctatgctgtgaacactgatgctcaggctttgcgtaaaagtaatgtacaaaaaacagttcaaatcggtggtgaaacaacaaaaggcttaggtgcgggagctaatcctaatgtaggacgtaaggcagccgaggacgatcaggatgctattcgtgctatgttagaaggtgcagatatggtttttattgcagccggcatgggtggcggaacaggaacaggtgcagcacctattgttgcacaaattgcaaaagagctaggtattcttacggttgctgttgtcacaaaacctttctcttttgaaggtaaaaagcgtatgcattttgccgaattaggaatcaaagaattatctaaacatgtagattccctgattattattcctaatgaaaaattattaaaagtacttggcaaaaatatcagtttaattaatgcttttgctgccgcaaatgatatattgcgtaatgcggtcactggaatatccgatatgattacttctccgggactaattaacgtggactttgctgatgtgcgtactgttatgtctgagatggggcgtgcaatgatgggttccggtgttgttcaaggcacagcagctgatggtcgtgcagaaaaagcagcacaagaggctgttgccagtccgttgttagaagatgttgatttatccggtgctagaggtgttttagttaatgttactgcgggattcgatttaactttagatgagttttcaacagtaggtgagactatccgttcatttgcatctgaagaggctaccgtggtggttggtacaacgttggttcctgaaatgtcagatgaaattagggtaactattgttgcaacaggaattggggacattgaaagacaagatgttcagattatgtcaacatctccactgaatgagcccgtaaaacctgttgaacagcagcatattcgtccagaacctagacatgatttagatacaccgattacagagagattaaaagcatttagacccgtagacccaacaagtttctctcgtgactaacagagttcatcttgttgtttagcaataaggttaaagaaagatgattaaacaaagaacattaaaacaaagtataaaagttaccggagttggcttacatagtgggaataaagtgacattaactttacgccctgcgatgccaaatacaggcgtaatatattgtcgaaccgatatgaacccgccggttacttttccggcaaatgcaaatgcggtacgtgatactatgctttgtacatgcttaatcaacgaggatggggttcggatctctacggttgagcatttgaacgctgctttagctggattaggtattgataatattattattgaggttgatgcgcctgaaattccgattatggatggaagtgcgagtccatttatttatttgttattagatgctggtattgaagaacaaaatgtagcgaagaaatttattcgtgttaagaagccaattcgtatagaagacggtgataaatgggctgaatttaaaccttatgatggcttccgtttagatttcacaattgattttgaacatcctgcaattggtaaagatgtacgtaattatgtgatggatttttctgcccaagcttttgtacaacaaattagtcgtgcaagaacttttggttttatgaaagatattgaatacttacaatcccaaggtcttgctttaggtggaagtttagataacgctatcgttttagatgattatcgaattttaaatgaagacggtttacgctttaaagatgagttggttcgccacaaaatgcttgatgcgattggtgatctttatatgtgcggttataatattatcggtgattttaaagcctacaagtccggtcatggattgaataataagcttttgagagcattacttgaaaatcaagaagcgtgggaattagtaagctttgaagataaagaagaaatcccgcaaggttatgtttctcctgcacaggtttttatctaaattagtgttgtaagataaaagctatatttccagcgaagtatagctttttttatagctatagtttttgcttttacctattacttgctggtatggaaaaatattcaattcatcgtaggattttatatgtcattagatttaaatgaaattcgtcaacaaattacacaaattgaccgcagtttattaaagctgctctcagagcgtcatcgtttagcatttgatgttgtacgcagtaaagaaattacacagaaagcattgcgtgatgttcaacgtgagcaacaattattgaaagagttggtgcaatttgcggataatgaaaattatcaattggaaccacaatatattactcaaattttccaaaaaattatcgaggactccgtattaactcagcaagtatatttgcaaaagaaattgaatgagcaaagagagaagaatattcatattgcttttttaggtaaaagaggttcctactctcatttagccgctagaaattatgcaactcgttatcaggagcaactaattgagctaagttgtgcttcttttgatgaggtattttcctccgtgcaaaatgaagaggcagattacggtattgtaccgttggagaatacaacctcaggagcgattaatgaagtgtatgatttattacagcatacagatctttctttagtaggtgaattggcttatccaattaaacattgtgttctggtaaatgctcaagatgatttggataagattgatactttatacagtcatcctcaagtgattcagcaatgtagccaatttattcgtactttaaagcgagttcatattgaatattgtgaaagcagctcacatgcaatgcagcttgttgccagcttaaataaacctaatattgcggctttaggcaatgaagacggtgggaatttgtatggtttaaaagtactaaagtcaggcatagcaaaccaagaaaacaatattacgcgatttattgttcttgctaagcatccgatcgcagtatcaccgcaaattcatacaaagaccttattgttaatgagtactgctcagaaagtgggtgctttagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaataaaaagtgcggtctaaatcaaaaaaatcccctttattgaaaaaggggattaggcgttgatttattttttcggtgcaagcaattcaggttcttgaggtttcgctacattttcaaaagatttattttgattcgcttgaataaggctgtctgcttgttgagccaattttgttagtcccattttttcgtaagcatttttcatcaatggcaacgcatcaagagtagcttttgtgtcaggatattgttgtaacatacccactacacgatttgctacagcaacatgagcattgcgttttgcatagaatttagcaatttccaattcatgacgagcgaggcttgctctaatataagccatacgtgctaaagcatccgacgcataagggctatttgggaaatgctgaactaacgtttggaagttagcaaatgcagttttgatagacgtactttcacgtgtcgcacgatctacaccaaaaaggtcttggaaccagttatcacctaatgctgaattgcttaaacctgctatataaatgacataatctaaatgcgagctttgcgggtattgttgaataaagcgatcaattgttactaaagcattagtgtagtcttgagatttatagtaagcataaattagatccaattgtacttgttcattatattggcttccggggaagcgttttttggccgtgtctaaataacgaattgcttggctataatctgcgtcttgtagatagctgtgtcctttttcataaagagtttgtgctgttccttcttcaatagctttacctgagcttgaacacgcaccaagagcaaggcttgcaaaagcgactaaagcgagagatttcaatttatgcatgagtgaatccttatttttacaatcaataataaatgttacaataattcgttattttatagcacattgctaaataagcaaattatctgatggattttttattatgacacaagtgatattgtcagccgatattcagccccaacatatgggacaacgcttagaccaaacgttagcagaattgttcccagattattcccgttctcgtttgaaaacatggattgagggtgatttagttaaagttaatggcgaaattattaatgttgctcgtacaaaagtttacggtggtgagttagtggaaatttgtgtggaaattgaagaagaaagcaggtttgaacctgaaaatttaccactcaatattgtttatgaggatgagcatattttagttattaataaaccaaaagattttgttgtccatcccggtgcagggaatcaaagaggaactgtattaaatgcactgttgtatcattatccaaaaatagtagaagtgccaagagcgggcatagttcatcgtttggataaagatacgacgggtttaatggttgttgcaaagacaattccggcacaaacaaaattggtacaggatttacaaaaacgtaaaattatacgtgaatacgaagcagttgcttttggtgtgatgacacaaggtggaaaagtagatcaacccatgtccagacatccgacaaaacgtacccaaatggcggttcatccgttgggaaaaccggcggtaactcattatcgtataatggaacgtttccgcaattatactcgcttacgccttcgtttggaaacaggacgcactcatcaaattcgagtgcatatggcacatatttcccatcctttactaggcgatcaaacttatggaggtcgtcctcgtccaccgaaaaatgcaagtgaagaatttatgcaagtgatgcgtgattttaaacgtcaagcgttgcatgcaattatgctctgcttaactcatcccattacaggcgaaataatggaatgggaggctcctttgcctgatgactttgtaacattaatcaatgccttaaaagcagattatcaattacataaagatgaattagattattagtatgcaaataataaaagcgaatctcggtcaagtagcgaatattcaagggctaatgacaactcggcaaggcggtgtaagtgttccaccttatgacagcttaaacttgggtgatcatgtcggtgatgatgaaagtgcggttaaaattaaccgcactttgttagtgaaagaattaggcttaccgcaagatcctatttttcttaaccaaacgcatagtacaaaagttctgcgacttccttatcaagaaggcatggatttaaatgcagatgcagtttatagtgatcaagctaaccaagtttgtttggtgatgacggcagattgtttaccggtactttttactaatagacaaggcaatgaagttgctgctgctcatgccggttggcgaggattatgcgacggtattttagaggaaaccgttaagcaatttcgtgttcccaaagaagatattatagtttggctaggtgttgctatcggccctaagttttttcaggtcggtaaagaggttgttgagcaatttatagcaaaagatcctcaagctaaaaatgcctttatgccggatcgggaacaggaaaataaatttctgggtaatctgtatcaaatcgccaaacagcgtctaaatgctttgggaattacagaaatttacggcggagaacattgtacatatagcgataaagagcggttcttttcttatcgtcgtgatggtaagacaggtcgattggcttcattgatctggttttccaagtaaaaaagagcggttagttgtattgagtatctaaccgcttaacagggaatagttattatccttcgaagccgtcaaacaaggctgtgcttaaatatcgttctgatgcagaaggtaagataacaacaatgagtttatcggaaaattccggacgttgtgcaattcgatcggctacagcgagtgctgcaccggatgagatccctccgagaataccttcttctgccattaggcgacgagccgttataatcgctgtttcactactgactttttctatttgatctactaaagataaatctaagtttttcggaatgaaccccgcaccaataccttgaattttatgtggacccggtttggtttcttcacctgcaagcgtttgagttatcactggtgattcttcaggttcaacggctacggtaataatttttttgccttgatcttgcttaatgtaacggctaattccactaattgttccgccagtaccaacaccagctaccaatacatcaattttaccttcagtgcctgaccaaatttcaggtcctgttgtttgttgatgaatggctggatttgcagggttttcaaactgttttagcattacatagtgatttggatttgaagcaacaatttcttctgctttagcaatagcccccttcataccgttgacaccttcagtcaacactaaatttacccctaaacctcgcaataagcgtttacgttcggaactcatagtctccggcatagttaacgtgattttatagccacgtgctgcagcaacataagctaaagcaatacctgtattaccactggttgcatcaataatttctttatctttggttaaaataccatctttttctgcttgccataccatattggcaccaatgcggcatttcacgctaaagctggggtttctcccttcaattttcgctataatgttgccgttattaccaaagttttttaaacgaactaatggtgtattaccaatagaataggaattatctgcataaattgtcattattttctcctaagagttgtgagtcgtattttttacagtatttttatcatagctttatgaatttcaaaatagcaaaacattctattttataactaaacgctatttcacaatcgtggttttaatccgtatgaggtttgttaatgtcgttcttaccggcataacgatattgttcaacccacatagctgttgcaccacagacagcaacaggaataatcagcaaattaatgagcggaataaatgtacataaagtcaccaaagtaccaaaagttaacgttaatgtatgtttctgtccaagttccgttttcatacgttgaaaaggcactttatggttatcaaaaggatagtcgcaatattgaatagccatcatccatacagtaaacaaaaatgctaaaattggaataatgctttgtccaataaatggaatgaaactaagtagagatagagcaataattcgaggtaagctataagtcaatttttgcaattctcgttttagcattcttggaatatcttttagaaaatctaccgcacttccttcagtcggactttctcccgttaacattttttccactttttcagcgagcaaggcattaaaaggtgcggcaataaatccagagagtgttgtaaacataaaataaaaaatgcttaacaacataagtacagctaagatgagcagaatcatacttaaccagctaagccaatcgggaataaacgtgatcatgctctcgagccaagtgctgaatcggtttataaataaccataacagccccgataaaagaagaatgttaagcaaaatcggcataacgacaaaacgacgcaaaccacgttgtctaatcaaatcccaacccataataaagtaatgaaaagctttttttatctctgttagttttaacataaattttccttaattgaaaaaacacacttatcaaacgacataataccgcagaattcaagtagggtaaaaaatctgtattttccatattaatcaacaagtaaaatatgataagctagcaaaaatttgctgttcgatgaagccaagtaggagaacaagataatggatttaaatgctattttaattattttaggtgtaatcgcattaataattttagttgcacatggcatatggtctaatcgccgcgaaaaatcgcagtattttgaaaattcaaaaaactttactcgagaggcacgtatccgtgaaccacaagaaaatcagcaatatcaaaccgctgatcaatctcagtcggattttcaacgtaatttgcttgaaactgataatgactgtttttctagtgaatcagcacataattctcaccaacctctttatcattatagtgagcaaagtgcggtacaatctgttgatcaaattaaaattaggttgcctgacagtgagcctaactatgtaatgcaagaacagttctcaccgaagcataccgactacgcctccatgagcattgaagaactggaaaaatcaattgatcttgatgagggaattaattcatcttctcaacatttacgccaagagctagctcaaatttcagggcaatcaatagctgatgataaggtcaatatagaagagcatatttttactgaaagcagcatatcttttgtagaaccacagacaaacacggaattccaacaggttgttgaaaaaacaaaatcaggtaattcttcttttatcatgctttatgtggttgcctctgaaaatcaaggttttagcggtttgcaattgactaaaacacttgatgagttgggatttatttttggtaaaaaacagatttatcatcgccatgtggacttaagtattacaagccctgttttgtttagtgtggcaaatattgaacagcccggtacgtttgatttaacaaacattgcagatttttacacggttggaattgcattatttatgcaactgccttcttatggtaatgttacagccaatttacgaatgatgattagagcggcaaaaaccatcgctcaagatttagacggtgttgttgtaacagagcaacaagaaatttttgatgaacaagctgaaagggattatttggctcgtgtttcttgagtggcaaaatttgggaaatattgaccgcactttatgctttaaactttcaataggcttttgtttaaaaatactgaaaactatttggatgtgggaattctacgtcaaaaatgctgtatgaatttgctataatcaacgaaagacgcaaaacaagtgtgaatttcagttaaattattgccataaaatatgatttatatcaataaagtattcaatgttggttgagtttgtaggctaaaattttgtagtatatgcaccatcaagtgattgcttgatgttcataaagttcctaaataaaataatcataatatagcaaaactgctttgtgacctccctcttgggaggtttttttaattaattacaaagttggaagtttaacgtttctttgactgataaactgttcttttcctgtatgtctatggcactaagtccttactcgctaaatttctacgttcaattcgctaaatcctataatttcaagtaaaataaccgcactttttacatcatagagagaatatatgtcatcacaatttgtttatactatgcacagagtaggtaaagtagttccgccgaaacgtcatattttaaaagatatttctttaagtttctttcccggtgcaaaaatcggagtgcttggcttaaatggtgccggtaaatctaccttattacgtattatggctggaattgataaggatattgagggagaagctcgcccacaacccggtattaaaattggttatttgccacaagaacctaagcttgaacctcaacaaaccgttcgagagaccattgaggaagctgtcgctgaggtaaaaaatgcgttagttcgcttagatgaggtttacgcattatatgcagatcctgaagcagactttgataaattagcaaccgaacaggcaaatcttgaggcgattattcaagctcatgatggacataatttagaaaatcaattagaacgtgcggcagacgccttacgtttaccggattggaatgccaagatagaacatctgtcaggcggtgagcgtcgtcgtgtagcactttgccgtctattacttgaaaaaccggatatgttgttacttgatgaacccactaaccacttagatgcggaatccgtggcttggctagaacgtttcttacatgattatgaggggaccgttgtggcaatcacccatgatagatacttcttagataacgtggcaggctggattttagagcttgaccgaggagagggtattccttgggaaggcaattactcctcttggttagaacagaaagagaaacgtttagctcaagagcaagctacagagtccgctcgtcaaaaatctattgaaaaggaattggaatgggttcggcaaaatcctaaaggtcgtcaagctaaaagcaaagctcgcatggcacgctttgaagagcttaactcaagcgaatatcaaaaacgcaacgaaactaacgaactcttcattccacccggtccacgtttgggtgataaagttattgaagtgcagaatcttaccaaatcttatggcgaccgcactttaattgataatctttctttcagtattccaaaaggggcgattgtggggattatcggagcaaatggtgctgggaaatccactttattccgtatgctttcaggacaggaacaggcagattctggctctattactttaggtgaaaccgtggtaatggcatcggttgatcaatttcgtgatgcgatggatgacaaaaaaacggtttgggaagaagtttccggcggcttggatattatgaaaatcggtaattttgaaatcccaagccgtgcttacgttggacgtttcaacttcaaaggcgttgatcaacaaaaacgtgtcggtgaattatccggtggtgagcgtgggcgtttacatttagccaaacttctacaagtgggcggaaacgtattactattggatgaaccaaccaatgacttagatgtagaaacgttacgtgcattagaaaatgcgatattggaatttccgggttgtgccatggttatatcccatgaccgttggttcttagatcgtattgctacccacattctcgattatggtgatgaaggtaaagttactttctacgaaggtaactttaccgactatgaagaatggaagaagaaaactttcggtgcagaagcaactcagccacatcgtattaagtataaacgtattgcaaaataattctttgtataaagggaaatattatgaaaaaaatcattaccgtattatcagttttagctgtatctgcttgtgtttcaacagagctatcgacacaaaataaggcatataacaatttacaagatgcacgtatccgtttatatgggcaaaatcgtcgtccctcatcaatggaaattgaaattaatggcaagactgaaaaaatcaccgttggaggtgggttgggacaggcttttggttcaatgcttggagttaaagggaatgaaagcattggtatgcctgaaactgaacttagcaaagatccttctgctcattcaaaactactttcgagtatcttctttaaagaattcgttataccggcaggtaaagaagtaaaagttactaacagtattcatgacgtaacgaatatgggagaatattatacctcaacacatagaataaccaccactacaacatttaaagggtgtaacggtgatgtcattacttttattgcagaagcaggaaaagattatgaagtggctcctattagctctaatagagaatgtggtgtaactgtttacgagatcaaataattttatcagaagcccattataaactgtctataaagtaaccgcactttaagtgcggttcttttatgttgcgtgattatggcaggctcaatatcagcaataggatattcacttttaccggaaaaatcattgaaaattaacaatgacaacataaagctttctagatgaaatcagcacagaagagttgccccgaaggcactaaaaagattagcgaccgtatttgttgaacaagaaccttgccgagcttttatctgggaaagtcaaaaagttcgtcgtactgtgctgtttgttgctaaaagtgttggttttattggaaacctaacctggtcataaaactctgtaaaactgtttgcggatctaaatatattgaagaaaacaaccgcacttattggattaaagtgcggtaagtatttagctcaaattggacgctgtgataagacgttgcgtataagcatttttaggttgggtaaatacctgctcggttgtacccgtttcgacaacctcacctttactcataacaataacattatcgcttagtgcttttactacagataagtcatgactaataaaaatatagctcaagccatattttcgttgtagtttattgagtaattcgatgacggtaatttgtgttgaacgatcgagtgcagaagtcggttcgtccagcagaacaaatttcggttcaagaataatcgcacgggcaatagcaatgcgttgtcgctgtccgcctgaaaactcatgagggtaacgattaatcatagagggagaaagattaacttcctccaacatattcatgactttttgtcgccgctcttgtttactcatgtgcgggcaatgtacagtaagaccttctgcaataattttatggggtagtaacaatatttgcataaagtaaaagaaaaatttgggtcggaaaaagttaggtgagggcttgtggttattgggtttgttgaggttggggcgttggttttatgcaaaatagggaaatgagcaggaatggtaaaaaatgggtaaaaattggattattttttgcataaaagtgatcagggtttagatggtttttaaaagatttttaaaacaggtttaaaactctaaaaatggtagtaaaaactaggcaaggcgatttcaggtgaaatcgcctttatttttttggggggaaatcttgtggttttggtgcgtttaggtgaaatctgacttatttttgtgagggattatgcctaaaaatcacgatagccacgcactacttgcccaataacgataaggctatttgcttcttcagcttctagctttaatgggcggtatgttgggttatcgctaattaactctaccccatcataggttaactgcacttttttcactagcattgacccatcattatttaaaacaaatattttcccatcaactaaattacgtttagagcgatccacaatgatttcttcaccatcttttaaggttggatacatactttcaccgctcaccaaaaaacattgcacagttttcagcctttaagtgctttgtttgtagccaaacaagttctacttttatcatctgtgagaactacacagtaaatttatttaactgtgtagttagtaccaattttttataaagtaaacagaatacataaaagaacaatataatcaatgtgttataaattttaggcgttttttttcggatttctttttgtgtagtctaataactctttttctgtgtattcagctaaacgcatattagcgattgaatgcttacaacacattttggctgtttcggagattaactgcttaccttgagtatcacttcttctaaaatttgccagtaactttatttcatccatattcagtaaaactggatttattgcatcagaaggcgtgattagtgaagggttaattgtggcagaataatcatccatatctatttcagttgctttatctttaatggcgttcacaagatcctcattattagcattatttggttctctaatcccagatagaatgtaattgatatccagttttaaatctggacgctcaagctctaatagtcttaaggcattttcaggaaatacacctctacgctttctttcagcaaaggcactttttgacatttttaaaagttcagccacctctttatccatcgttaatgatagttcagtttttaatcgattggcgatgtctgtgaaatttttcataaaaaacctcttgaaattcataaaaatcatatttaatatgaactcagtaaacaataatgaactttatgatttcatattaattcgtattgttcttattctagttcaaaatatgtttttagtccatagaggagtttatatgaaaaaaagaacgagagatgaagctaaaaattggttcagagaaatgaatgtaacgcaatctgaatgggggcgaagaaatggttatagctctaatgaaattagccgagtattgacgggaaaatcaaaatgcctttatggaagagaacgagaaattgctattaaactcaatatagctttagaaagttagaggttcatatgtgtgaactaaagccatactattctgctcaagagttaataggtttacagctagtaatcttaccaacgaccaaaaaagcagtaatagacaaagccaaacgcgaaaattggcaatctcgtaaacgtgttggtcgtggcggtggtgttgaatacgccctttcctctctccctcaagaggtgcaagaggaaatcagagataaatttgcgacctcggttgtggcgggcaagcctaaaaagttgccagtgttgaaatcggtcgtgttggaagacctcaccgaaaaacaacgccaagcggcagatgcaagaatgacgttagtggcttatatcttgcagttggagcaagcacaacctcgttataaagcggtgaagtttttttgccagcaggcgaaacaaaatttgttatcacctgaattaatggcattagtggctaaggcgaataacaaaaaaggtgaaagccgtgtgattggtgaacgcaccttaaatcaatgggtgttggattatgaaaaagcgagcaccccagaagaacgtttaaaagctcttgcccctatgcaacgggtggcaaaaaaggcagaagacatttcgtggttgcctgattttctagcggaataccgccaaaccaatggcattaatgtggcagaagcctatgggtattttgctcaacattggcgagagcgttttgaggatcaacccttaatgcttgagatgttgccaagtcttaatcgtgtcagaagagcgttagccaaattgcctcgccatattaaagaaattgggcgtaaaacggggtcagagcttcgggcattaaacacttatgtgaagcgggattggtcgaaattgttggtaaatgacatctgggtaggcgatggacacagtatgaaaatgaaagtggctcaccctgaacacggtagcccttttatccctgaaatcacgctgattatggacgccccttgtcgttacattgtgggttggtcggcaagtctgtcagaaaacgcccttgcggtggcagatgcgttacgcaatgggatcgaacagcacggtatccctgcgatttattactccgataacgggggcggtgagaaaaactggctacttgatggggatattacagggatgttgccccgtttaggcatcaatcaccaaacagggataccgggcaacccacaagggcgtgggattattgagcgggtacaccaaacgattttataccgcattgcacgccaatttgaaacctatcacggcagcggtgctgatagggaaacggtgagaaaggttagcactggcgtggtatcccttgaaaaagccttgcgaaaaggcactgcacttgaagatttaaccccgaaacaacgcggggctatgggtaagttacccagttggaatcagtttttagatgcggtgcaagcgggcatagattggtacaacaacgagcataaacacagtgaaatcggcaatgttacccccgcagccaaacgccgtgaattaatggcaaaaacgaatgaagaaaacttggtttacctcacccaagttgaagcacgggatctgttccgcccagcggtagagcgtacaccagagcgaggttgggtgcggttgtttaataacttttactttagtgcgaagttgttagaggtagatagagaaaaagtgcaggtggcatttgatattcacgacccaagccgtgtgattattcgcaggctagatggggtgtttgtctgttatgcagagcttgatggcaataagcgtgatgcgttcccgatgagttttgtggagaaaacgagaaaagagcgtcatcaacgccgaatgaagctaaaacaagagcaacttgatgaaattaatgcggaactcaaccccgtgcttaccattgaacacaaagaaagtgcggattggttacatcagttacgcataaataaacaaaatgaatgggaggaagacgcggaagaaattgcggttttcccaagtgaaatgaaatgtcaattattaaaaagaaagacaggttaaacaatgaaagagcaattacaacactatatgcagacacaggggctaacgcaggggcaaattgctaaggcgattggtaaatccatcaccactgtgagccagtatttaaaaggcaattacaacgggaaaaccgatgaaattgatgatgccgttgcccgcttgttgcaacgtgaaaaagataaggtggtggaacgccgttttaacagcgaatttgtggaaacttacgcggcacagcgttgtttagatgctatctacattgcccacgcagaaagtgatattgcagtgatcacaggggcggcaggtttaggcaaaacccaagcactaaaacactacatggaacgcaaccctgaaaccatttttgtggaagttgaaccaagttacagcccgaaagtgttacttaaaaatctgtgtcagcagttgggactaaacgaaaacggactaaatcacgagctctttacccgtatcaccgaaaaacttggcgaaaaccgcttaattattgtggacgaagcggaactattaagcacgaaaagtttggaatatttacgccgtatccacgatttaaccaagtgcggtgtggtgttggcaggaatgccgagattaatcgttaatttaaaaggtaaatatggtgagttagcccagttatacagccgtgcgggcgtacattgcgatttacaaaacgccctagataaggaagacatcgccttacttgcccagcaaggcttaggtacggacgaatttaacgacctgctttacaaagtaagcaaaggcaacgcaagacgattgaacaagttaatgcgtggcgtgatccgcgtggcggaaatgcacggaaaaccgattagcgaggcactgattaaccgttatgcggaaatgttgattaattaaggaggaaatatgggctttaaaacaaaagagtttgataactggataggaaaaaatggtgacattttgatttctaaaaattcaaaagataaatggattgctgcagggggatggagcgaagaagaggacgactttactttgtacagcgtattaaagaatagaaaggcatggctgaatttttaccgtcaaacgagagtgactaaataaggattaaggagaaagaaaatggcaagagcagacattattgacacagcttatgcgttacgtcgtgagggtgtggagattgtgaaatcaaaagatgggcgttttccgagttttttaattttacgcccaagccaacgcttaatagcaaatgcaacgcagattgtggaacgcattaacgggcaacgccgtgagcggtttatcactcaagtgggaaattgtacggtgtactggttttgaggtgagcaatggcaaagtctctggatatttacgccgtctatgagggtgaggataacttaggtgacggcacagcggaacagttagcaaagcaatttaacttaagtaaaacaacgatttaccgttatgctaagttaggcgataaaggaagtaagaaaaaacggttaatcatcatcaaaattgataaagaggaaaaagaaaaatgaaaaaaattgccgtaatttgcaccgcacttttgttggcggggtgcattgaaaaagcgccacttaatgatatacagccaataaaaaggtatcaggtaagcacatacggcgaacttaaagaggtatgtattgatggtgtggtgtatctactactcataaagggtggtattaccccaaaaatcaacgccaattatgacgtttatatctgtaaccaatcaactaacccataggagaaaacaatgaaaactgtaatcgaaggcaaaacctactggaaagatgcaaaaggcaaccttaccccagaagaattagtgaaagacatcgacaaagaacgcgatgcactggtgcaagaatgggtagaaaaagccaaagccttaaacgcggaaatgagccgttttaaaggcgggatttttggcgatattcaggcgtttgtggaactttccgccgaaaaatacggcacaaaactgggtggcaataaaggcaacgtaacgctatttagctatgacggtaaatacaaaatcgtgcgagcgattagcgatcatttgcaatttgatgaacgcattcaggcggctaaggcgttaattgatgagtgccttagcgaatggtcggaaggctctcgcccagagctaaaaaccttgattgagcgagcgtttgatgtggataaagaaggcaatatcaacacagggagaattttaggcttacgccgtgtggaaatcaccgacccacgttggctaaatgcaatgcaagccattagcgaaagtgtgcaaatcgtaagcagtaaagcctatgtgcgaatttatgagcgggtgggtgatagcgatcaatatcagccgattagtttggatatggcggggatgtaaaaatgtttgaagatgttagtgatttaaaagaagcctatgatttttataaagcagttaagaaagataaagatgctattaggtgtggttgtttaagtgacgcagaagattggatatggagagagccgcatgcgttatttgcagaagacgatgagcaggaggtatagcaatgttagagaaagttgcaaaatacagtcgaattttttcgggagcagtggcgattaccatattgctgattgcagtgcctgtgttttttatccacgaagccgtagcgataaagttgatggcgtcagcgtgtaatttttttgccatttttgtcttttttgaggttttaaaccttaaaagttgggtacaacaaaatatcgcaacattgataaaaagtgcagaaattgcatcaaaagccgcttatagcttaaagcagcataaagggctaaatcttgtggtcaatggcaacacagttacacctgatagtagtgaacgggaggtataaatggaaatgttactttatatcgctgttggcgcatttttattccctttttgttttggtttaggttgtatatgcgtctataaaatgatggagaaattggtcaagttaaatatggattaaagcccttttcaacacgctttaaagcccatttaaggcgtgtttataaagtgttttaaatcaaaaaataggagcaatgacaatgaattatcacgctgaaatagacgttaaattgactttgggtattgaagctgaaaccaaagacgaggcgatatgttatatcgaccaactactggaagaaatccatgaaggctacgctattggtctgaagtatcgaattaattttgtaaatgaggaatgcgacgatgaagaataaatatcttgtcagagtgtacggaatggttgaaatcaccatggaagccgaaagtattgagcaggcaatggcacaatgtgatttgaataccttagatttaaataaattgccacatcaaatcactgaaattgatgatgtagttgaagtggaggaagtatgacaaagcaaaaacaaagcgaactccagctcaagctggatatgatgatcggacagcttcaacaggcggttagagcgattaatacgggcaactatattgcggcgggggtgtatatggaaatggtgcaaaaccaactgccaaaggcgagatggcaggtaagggggtaaagatgaaatcttttacattaattttaacagcaacttttgattttcgcgatgatgaatttaatgatatcggttttaaatggtctagtatagacggaaaggcattattagatgcgccaagagaactggattttacaatttataaattgatgaaagattgtacttacgcattgcctattttatcccatttttttaaggagtttagtcaagagaagcaacccgtcatggcaactgcaagcgtgcagtttgaaggggaaaatgaggattggcagctagctttttctgcactagaaaaaaacgaagtaaacgaatatatccaaggattgctttttgggttgctaacacagagaaatgaacttttgcggaaggtgaagttattggaaaaggaattgtattaaaacccatttaccgcccttttaaatctcccctagcccctctttaccaaagaggggaactgaaagggcggaataatgtgttttaaccccgttttaaaaggagtttaaaaatgaaatgtaaatgccctgcgtgcggggcggtgttgtcgttagatgtgttgttgcaacacgagcaagcgagccttgcggtgatgaatgccttatcgctcaatggcgagtttgggcggttggcggtgcagtatttagctctattccgccctgaaaaatccgcactcacaatggatcgcttagcgaaactactcagtgaattggttgatgaggtgcaacgcgggcagttttgccgtaatgggcaggtttattcagcccccattgaatgttggattgatggcttaaccattgtgttaaatagtcgccaccatatcaaacgcccctcgcctcacacggctatttgtatgaggtgatgaccaaatggcaaggcagaaatagccatcataatatgatgaacggacaaagtaatccgcctgccactgccccacaattcggcagcaaaacgggcaaagctctgcaaaatttagcggagtttgccaatggctgacgaaaaatggctaaaacgaaccgtagctcaagggttgggaaaattggtggtgttacgccttgccaaccaaccgcccgaagagatgatcaaggctacggcagaagtgtgggtgcaggtgattttaagccaacgcatttatggcggctggcaagagaaagaagataaatggcgaattgaacaggcgtttatgcggttatgtgcagaatgtgagcgtttccccgccccgaaaatgctgttagaccgcttacccaaacgtaaaacccttgaactaccaccacctcaaccaaaaccattaaccccagaacaacaagcgcacgtcagtaaaatgttaaacgaatggcgaggagtattaaatgcaaaacgatagttaccgaaaaaatctcattgctaaagtgcatattggtaaaagtcagttaaaaatggacgaagaaacctaccgcacttttttaatgaacgccgtaaataaaaccagttgcaaagcaatgagtaacaccgagcttaatcaagtgttggatttaatggcacaacgtggggcaaaagtgtggtcgaatttttggggaaatcgcccaagtccagctaaagcgaaaaagccgtaccttgccaaaatcaccgcattacttgctaagcataatcttacaccgcaatatgctgacgcgattggcaaaaaagcctttggtattgaatttattgactggcttgctgtgtggcaattaaaaaaagtgattcaaatgttgtcggtgtatgataataagaagaagttgtaaaatattttgcataagtataaattaaaggttcgttttgagccttttttaatggagcaaatatgagaaaactgataaatctcttaatatttacaataatacttattccagtatcactgcaattattatctaatcctgcttggggaaagggtcgttatctgccaaaatgcaatgaagtagatgatcttttaagccaaattttaaatcagcaaactaaagaaacaaatattgacttaacgctcaaaaacattactgctgttagagaggtaaaaaagatagaacaagataaaaatatacgtctttgctacgcaattttacaaacggcaacctacaataaactagaagcattatattcggtttctcctgatggtaatgatttttgggtgcaaatagaagaagtaaaccctattattgatgccaagacattaagtaaaacgggtgatatgttaaataatcaaatgggagaagatagattacaggcttttgaaatggcgaaaaaatttggtgatatgaaagaggcttgtctatccttgagtgtcgccaaaaatttttcttaagtgcaaaaaatgaggttaaatatatacaaaccaataaactattagaagagttctgcaaaaagtaagtataggctatctaaaatcccgccaagtgcgggatttttttcaaaaaattctccagttaagtgatcgtttgaaaaatcccgtgtgataatggcgaaaaaatcaatacgggagattaaaaatgagtcatcttgaagatgttgcagactgcttaccccctgttgtactggaaatggtggatttggtgggctttgaggtaaccgaaaaaatcattcgtcattttggcggggtatgttttttatttagtgatggtgcgatgtatttcccgaaactaaaatcgctggttggattagaacatgccaccgcactacgccagtattttaaaagtgaagaagtctatattcctcgctgtgaagtggcattaagaaccttacgtaatattcgcttggtgaatgactttttaattaaaacccaagtggagggaaaaagcgggcgtgcagcaatgttggaactttgcaccaaatatgccctttctgatcgccaagcgtgggaaattgtgcgtaatgcccaacgtaactcaccgcttgcaaccaaatcatccctattttaactgtggaagtgctttgtctattaggctaaccacacaaatctgataatcacctcaataatgtctttgattattgaggttttttatgccctttccaattacaaaaattgtggtgcattgtagtgccacgcagaacggtaaatccttacgcaatgaaaggctaaccgcagcccaacggattgatctttggcacgctaagcgaggttttttgcggaaaaatcaccaatttaacccgtacttacgccatatcggctatcactttgtgattgataccgacggcactgtagaaacaggacgtgcagaaggagaaatcggcgcacacgttaaagggcataacgcccatagtttaggcatttgtcttgtaggtggcattagcatcacaggcaaaaactacggacgctacactgtcaaacaatggcaagccttgtatcaactcttacaaaagttagaagccaaatacccagaagcacgcatttgcgggcatcgggatttatcgcctgatttaaacggtgatggcacgattaccccaaacgaatgggtaaaagactgcccgtgctttgatgtttgggagtggctggatagcgagcaagtgattaatcaatcacacttatttaaggagtaattatgccaacgactattttaggtattatcgccgtaacaatggtaatcggttgttttttcaaggtcggggaagctatcggagcttgtatcggcgatcagattaaatatcgctatgtactttggcgagataaacgaggggaaaaatgaaactcagtgaattaattaccaacgataacggcaggcttagcaccaccgcctttatccaatttttcggagcggttttaatggcgatcattttggcgtatagcgtctatttagaccgtgcaaatgtaagcgaactgtttaccacctttgctttattttgtggcggcggtgtggccaccaaaggctttgccaatgcccttaatcgccgtaaatcttcactagcacaaggagaagaacaatgatgtggcagatgtatgcccttgcggggctaggtgcagtgtttgtggcgatttatgctcggttacattggcaaagtaaaaaactcagtgaaaagcaaaaagaaatcgaaatggtgaaagccgaagccagagccatcgcggaggaaatggaaaatgcagaaaaacgtcagcaaattgaagcagctcatcgccgtcttaacgctcacggcgttgatgaccagttgcagtcaaaaggttacttccgtgaggattagcggttgcagtgcgtttgggctgatttaccccagtcgtcaagatacattagaaaccaaacggcaggtgctgaaccataatttagcctatgagcagatttgcggggtgaaacgtggatctacaaattagcggtgagtgggtgtttaacggggtggtatccattgccgttacctttgtcgggttttggttgcgatcggtcaaggaagagctgaaagaactcaaacaagaatgcaaagacatccgcaataactatcaaactaaagagcttgccaaggtgcatagcacacacacggacaatattttggcggaaattcgggacgaattaaaagcaatgaatcataaattagacagcaaggtggataaataatgtcagccagagaacaaaagcgtttgaaccaacgcaacaccaacgaaaaactcgatgaactgttggatttaagcaaagaagcgaatcgcaaaatcgaccgtattggggagcgggtcaatgatattgatcatcgtttgtcatcgctcgaaacccaagtgggcaaagtgaccaccaaagcctttgtggctggcggtttaggtggtgcaatggttgcggtgggcattgagttaatcaaagcaaaatttgggggctaaatggctcacgatgagaaagtgcgggcattagtacgccgttattatgtgtttgaccgctttacccttgagcaatctgcacaaaaagccgacgtgtcttttggtacagcgcgccgttggaaagcgcaagccctaaataaaggggacgattgggataaggcgcgcgatgtgcatattatggcaggcggtgaagtgaatatgatttcgcaaggtttattggcgggatttattttgcagtatcgcaccacaatggacgaattacagcaaaacactgaattgagtgccaaggataaggtgatgttacttgccgcccttgcggatagctttaccaaaatgacggcagcaagtaagcggattttgccagaagtatctgaattggcggtggcaatgcgtaccgttgagttatttggtgagtatatccatcaacatcattcttccctaatggagccttttattgatgcattgaatggatttgggcaaacactcaatgaggaatttaaaaaatgaacctattgagttttctttttgtgattgcggcttgcctttctgcccgtgatggtggggcgtggggctggtgggtatttttagcattattagtgagtgattaaaatgaaaagcaaagattttttgaaagaattaagtgcttatgctgatagcctacggcaaaagttagaagcctcttttgagggctggaatgatagccctgaagccgtggttgaacgccgtaaaaaagtgtttgatacgatttcgggttatgaatattttgtcaatcattactttccgcattacacccgctcaagctcaaaatccaaattgcatcattatctatttgaacgcttgcccgccattttacagcaagagaaaggttgcctagatgccattgctgcaccccgtggtgaagctaaatctaccttggtttcgcagctttatactctttattgcttggtgacccaacagaaaaaatattgcctcattgtcatggacagtatcgaccaagcctacccaatgttggaagccattaaagtggagttggaatttaatcaacggctacgcattgattttcccgaagtggcaggacaagggcgtgtgtggcaagcagcaacgattgttacccacgctaatcaaaaggtgcaagtggcaggttcgggcaaaaaattgcgtggtttacgccacggggcatttcgtcctgatttggtggtgctggatgatattgaaaatgacgaacaagtcagaagtccagaacagcgggataaattgcataactggttaaaaaagaccgtgttaccgcttggctctgcgggggataaatttgacattgtgtatatcgggacaatcctgcattacgacagtgtactcaatcgcaccttgcacaataaagcgtggcatacggcaaaatttaaagcactcacaaaaatgcccgacaatatggcgttatgggataagtgggaagatttttacctaaacgagggcgaagcggttgccgatgccttttatcagcaaaataaagccgaaatggacgcaggagcggaaatctcttgggcagctcgtccactcttggcgttaatgaaaatccgagcacgagatggacacgccacctttgatagcgaataccaaaacgacccggttagcggtgatgatgccatttttgccaacagtatccaatattggacatcactccctgataacctgatttattttggtgcgcttgacccttcaatgggtaaggcgggagctagtcgcgacccgtccgcaattttagtgggtggctatcatcgcgaaacaggcaagctctatgtgattgaggcgcagattaaaaagcgtctgcccgatttaattatcgaagatgtgattaggctcaatagccaataccaatgccaccgttggtttgtggaaacggtgcaatttcaggaatttttgcaaacagaacttgttaagcgttccgcccaacggggcaagcctgtgccagccacggcgattaaaccgaataccgataaaatgctacgtattgagagcttacaaccgcatatcgtcaatggcttaattttgttgcatcacagtcaatccaccttaatttcacagctacgtcatttcccaaaagccgaccacgatgatggtcccgatgccttagaaatgctatggaaaaatgcggtgctcaactctgcctccattgagtggacaagcctgaatgaagcagagttagataacgattggcgtgatgaagatgatgatatttatagcatttggaaaggataaacaatggcaaagaaaaaacgcaataagcacaaacaagcacaaaataaaagtgcggttaaaattgggcaagattttcaaaccaacgaagctcgtattacggagaatgggcggattatttccgaccacccaagcaataaaatcacgcctgccaagttaaaaagtatttttgaggatgctgaggcgggcaatatccaaacccagcacgaactctttatggatattgaagagcgggacggcgatattgcggcaaatatggcaacccgcaaacgggcgattttaacgctggattggcgaatcgccgaacctcgcaatgccacgaccgccgagcagggctatcaacaagaggtggacgaatatttttatcaattttccgagctggaaaacctgctgatggatttaatggatgcagtgggccacggcttttcggcgttagaaattgattggcattttattaacggaaaatggcaaccaaaaacctttatacaccgtccgcaatcgtggtttaagattgataaagacgacaatttattactcaaaacccctgataattacgaaggtgagccactacgcccattgggctgggtggtgcatacgcataaaactcgctcaattcagttagctcgccttggtttgtatcgtacacttgcgtggcattatatgtttaagcattacgccgtccacgactttgccgagtttttggagctgtatggtatgcctattcgcattggaaaatacggtgcgggggcaaccaatgaggaaaaacgtacccttttgcgtgctttggctcaaattggacataacgcggcgggcattatgcctgaaagtatggaaattgagctacataatgcggcgaatggctcaagcgttaataacccatttttgcaaatgattgagtggtgtcgtaccgagattgctcgcctgattttggggcaaacgctcacatcaggagcggacggtaaaagctcaaccaatgcacttggcaaggtgcataacgaagtacgccgtgatttgctgattgccgatgccaaacaaattgcacagaccattaccaagcaaattattttgccttatttacagctcaatgttgatccgagcattgatgaaagccgctgccctcgctttgagtttgacaccgcagaatatgaggatttagaaaaattcgccaaagccttgcctgatttagtcaatatcggcgtggctgtgcctgaaagttgggtgcgggaaaaattgggtattcccgaaccgcaagagggcgaagcgattttaaaaaccgttcaaagcgactttaaagaagagttaaatgatgatgaaaaagaagaaaaaaccgagcaaaaacgcaccgcacttactttcagccctcacactgactgtggttgcggctgccgccaaaccgccttgtccaccgaaaaccaaagcacggacgaacagcagattttagataatgtgctagatgagggcttgcaacaggtggattttaacgcccaacttgatcctatggtacaaaaagccgtggcgttgatgttgagttgcgaaagttatgaggaagcgggcgagaaactggccgaggcttacccagatttagaaagtgacgaacatcacgcttatttaagtcgtgcgttatttttaagcgaattattagggggcagcaatgcccgccgttaattttgctttggggcttgagccaaaagaagccattgcgtttttgaaaggcaaaaaagctttacttgaccatttggacgagaaaggcttgctggaaagtgccagagccaaagccacacgcattgcgaacatcaccagccttgaaatgaccaaagatatttatcaatcgctgatcatcgctcaagagcaagggcaatctttcggcgagtggaaaaaaggcatttttgaacacttcaaaaagaaaggttggattgcgggctatgacaaaggctatttattggctgatccaaaaacaggtgagttttttggcacaccaagacggcttgaaaccatttaccgcaccaatatgcaggcggcttactcggcacagcgttatcagcaaatgcgagataatgtagatagtcgcccttattggcaatatagtgcggtcaatgatgaccgcactcgcccaagccacagtgcaatgaatgggttggtgtatgcctatgatgatccattctggcataccttttatccgcccaatggctttaactgccgttgcacggtgattgcgttagcggaaagagatattaaacggcgtaacctcatcgttagccaaagcgaggggcgattggtggaatatgaacgcaaaatcaatcagcgagaaaccgagaaaaccacggcgtttaaggtgagtgaagatcgttgggtgatcaccgaccgagggtttgattacaacgtggggcgaacgagctataaacccaacttagacctttaccctgaaaaactcgctcaccaatttgccaaacgggaaatgagcggggcgggctttcaatgggattttcaccaatttgaaaaggaatttaaggcagctaaacaagccttaaagttaggcgataaaccgaatagtacgcaactgaccgccatccgtaaccaactacggcgggaatataaatttaccgcaggcgtattaaatgcggcagataaagccaagctcggtagccaaactgcgaccgtgtggctgtctgatgatacgttaattaagcagtttagtagtcgagaggggcaaaatttcggggctgaggagtatgcggtattgcctgagttgatttatgaacctgatatgcttttacctacaagagaaaagcatttccagttttttaaacaaattaaaggtcatagatatactgtggttttgaaagtattggaaaatgaggtctttgtgcaatcattcagaaaaatgagtgagaaacagtgggataaggcattgaaaggtagccactaggcagggctcgaacccactgcacacaatccccggtactctttcaaccgctcgtccgcgatcttcgagattcatcgcttttctagtggctgtgttgaatatacccttttttatttttaatgacaataggagatgcaatggaaacattacttaacgacaaaaattggcaggcttacttacccttagctttgagcctacaggaaaaagatgagattaaagccgcattgctgaaaaacatagcgcaaacccctgacagttttactgcgctatgtgaatacttaagatgcttacgcattattgaagaatatccgttaaaaacggaataagtaattatctatgctggatttgctcttggtatagccgtttagaaatagccaagattaattgagttaaatgctcggcggtttgctcaacctcttttgtatcattaggcagagtataattggggtgggtaatgagatcacgagctaactcaatagcgagtttatctgtattagtagttctttctattttcatcgttatttccttatttaaaatgggcgatattacccattcttagggtagcagaggcatattatgattgaaataaaaatcaataatgaaaaagaggtctttgcgttattggaacgcttaagccaaggtgtgcgttataacgcccctttaatgcgtaccattgcagggacaatgcaatcagcggtcgatcaaaactttcaggcaggtggtcgtcctaaatggctgggggtaaaatctcgctccaatggttcgcccttgattgatagtggggcgttacgcaatagcattcgtgccagttgggataatgatgaagcccttgttggcacaaatttagcctatgcggcaattcatcaatttggtggcaaaaccaaaccgcataagattaaacctgtaatgaaaaaagccttgagctttgggggtattgtgcgaaaatctgttaatcacccaggaagcaatattcccgcccgtccatttttgaccctaactccacaagatgaggcagatattttagaggacgtgcaagactattttaaacagataattaaataatgctatttagcccctaaatcgcacgctgtgcgattttttcttttagggggtacgatttatcattcaaaaatttttaaaataaattaaaacgatttaaaacggttttaaaatgggttgtgttttaaatcagtcagcttctttctatttttcagctatctctcttttccctctcctttctgttgtgtggaagcctattcacagttttagcacatcgcaaatcgctatgctatgtcaagattaagcaataaaggatttttttgatgaaacttgcagcctgtagttttgagttgagccaagccaaaaatgggcgtatccagttgttgccttacggtgcatttcgagccacagacggacgaccttttgacgtggaggcttggtatgtaacagacacaaacggtaacgatgtggtggcattggcaaatagccaacgcaacccactcccaattgattacgaacatcagattttgcactcacaacaaaatggcaaagaagcaccaagtgcggggtggatggattacctctattttaccccgcaaggtatttttgccgatgtgcgttggacggacaaagccgccgactatatcaaaaacggggaatatcgctatatctctgcggtgtttagttatgacacgcaaggctatgtacgcaaaatctttcacgccgccttaaccaatacacctgctttagatgggatggatgaggtgatggtggctgccagccaacaatttttaaccaaccaagaggaaacaccaacaatggataaagccttacttgcggcattgtgtgcgttatttaacacgccgaatgccaccgaagctgaaatcagccaaaaaatcaccgcacttgcacagtccaaaggagatagccaagtggcgttatcagaggtttacatcaagctcgctgaaaaagagcaatctgttgtggcattgaccgcacaaattgccaaccctgaccctgctaaatttgtgccagtggagcaagtcgctgccttaacggccgagttcacgcaatttaagcaaggcattgagcaaaaagaaaaaaacgcattaattaccaccgcactttcgcaaggcaagctcgctcctgcattaaaagactgggcagaaagtttaaaccttgcagcattaacggattatttagccaaagccccagcgattgccgcattaagtggcgaaccacaagccaaaactgacccgaacgaaaatcaagtggcagccttaagtgcggaagataagcacgttgcaaaaatgctgggcttaacggacgcggaatatcgtaaaaatttagaaacaggagcttaaccctatgagcgttgaatttaaaaaatcagaaatcttaaaaaaattagatacccaatttcgggcggaatttagcaaaggaattgcccatattcaaccacaatacccgaaaattgcgatgactgtgccgtctaacaccgcaaccaatacctacggctttatgcgtgcgttcccgaaaatgacggaatgggcaggcaagcgtacgattaaaaatatgtcagcggtgggaatgacccttgataacaaaaaatacgaaagcacggttggcgtaccacgtgaagccattgaagatgaccaagtgggcttattccgcaatatgatggctcaagcagggcaatcggcagcggaattgcctgatgagttgatctttaaattgttgcttgcgggtgaaagtacgctctgttatgacgggcaaaacttcttcgacaccgatcacccatactatcaagatgtcgatggcacgaatgcgggaacagcacaaagtaacattaccacaggttctgatagcggtgcgaaatcttggtatgtgctagataccaacaacgtgatcaaaccgtttattttccaagagcgcaccaagccagagtttgagggcaaatttgatccgtctaagtcagataccgtgtttatggaagatgtgtatttatggggcgtgcgttatcgctgtaatgcgggctttggtttttggcaactcgctcacaaggcgaaacagcttaacttaactgcggataatgtgatggcggttattaccaaaatgaccaccttaaaagccgatggcggggtgtttatcaatgtgcgaccaaccacgcttttagtgccaccaagtttagaaaaagcggcgttagatatttgtaacgctgatgtgattggcggcacaaccaacaccttaaaaggtcgcttacaggtaatggtatccccttacattatcgaataatcatttttccccgcctgcgggcggggcgttaaggagaaggattatggcaagaaaaaccaaagcccagaaagaaaaaacggaagcggaaaaagaaaacttagaagctaacgtgaaagatgacgcattaaaaaacgatgctgaaaccgaccgcaacctagaagatagcacgacagccaaggcagaagatgagacggtaaaaaacgctgacgaaactgaccgcactttagaagagggtgcaacagccgaggcgggcgatgaagcattgaaaaacaccgctgaaactaactgcactttagaagatgacaaggtggttgaaggtgggcaagtgattaacccgattgcttatgctgtcaagttgcgtgccattcacccgcacgacagctacgggcgttgtggttaccgtttttacaaagacaaagaaacggaaatcccagcgaacgacttaacgggagagcaggttttaacccttgcggaagatccgtggttagaacttgtgccagtgtgtgaggaatagcgatggcttatgcaaccgttgccgattttgtcttgcgtgtgggtgagttacaagccattgagctgaccgaccgcgatggcgtgggggaaattaatgagcaggtgttagaacttggactagcggatagctcaagccagatggacggttatttgtcagctcgttatgccctgcccttgctctccgtcccacaaaacttagtgcggttgtgttgtgatttaacccgctaccgccttgccagtatgtcgggagtggatattactgatgagattattgagcgttacaagctcagcctaaaagagctggaacagctagctaaaggagctatctcattagggttgccagagcttaatgcagacagtgaggacagcgagttttcaggggcgatattttttagcaacaataaaaacagggtatttagccgtgataacaaagattgaacaagccttaactgaccgcttgcaacgaggattaggcaaactggttaatacggtgaaaagttatggcggtgaatttgatgatgagagctttagcacagctcggctacctatgtgtttaatcacttatggtggctctcgcattgaacgaaaagccactagtgcaaagcgttatcaatccaccgatacctttgtgattatgcttgccgtgcgttctttgcggagcaatcaagccgcccgtcaaggtggcgtggataaacgcgaggtgggggttaatcagctcattagtgcggttcgccgtttgttagatagccaaaccttagggggattggtcaaaccgcttaagcctacggcagtgcgtaccatttttaacaatgccaagtttaacgcgagttcaattactgcttatgcgttggaatatgaagtggtgtatgacgatgttagcccgttagaagatgggttatatcccgaacctaccaccgatgaaaccagccctgattatgtgtttagcgtttatcagggggagcaatccgatcctgcaccgacattggaacatattaattttaatctttacaacccagatactaacgccgatcacccttttgtggtggcgatggaggaaaaatgaaagtaaaagccgcagttggcattaaagtgccaatggaaaatcaaccttaccgctatattgagcaagagccagtggaggttgaagacagtatctattatcaacgtcgcattaatgacggggatttaatcgtggtcaatgaaccgcgtaaccgaagaaatcgggaggcaaataatgactgatactaatatcgaatttgagcatattccaacaagccttagaatgccgggtgtatatagcgaatataacgctcaaaatgctgtgagtaccttaccaactaatgagcaaaatgtattgattattgctccaatggtcgggggcgatacggcttattctgcccctgtgccgatttattccgatattgatgcgaaaaatgcttttggggcaggttcttgggggcatttaatggctcgtattgccattcaaaacaacccgatgatccgtttaacggcaattggcttaaaagataatagctcaggcgttgcggcaacaggaagcttgaccttaaacggcacagcaacaggtgcgggcgtaattaaagcgatgattggcggggtggaatatgccatttcagtggcaaaatcggaaaccgccagcgacttagccacccgattaagtgcggtgatcaacgcgggtgaatattgccctgttacggcatcggtgagtacggcaaccttaactttgacagcaaaatgtaaaggggaaattggcaatgagattgaacttagcgtacaaagtactgcacaaggcatttcagcggaagccagtgcctttgcgtcgggttcgcaaaatgccgatcttgcctctgcacttgccagtgtggcaggctcgcattatcacattatcatctcgccgtttgctgatgataaaaatgccaccgcacttcgcaatcatcttgagcttgttgcaagtccaacggagaaaaagcctgcgattggggtgctgggttggcgtagcacgatggcagccggcacaacctatgcgagcaaaattaatgccaaccgtatcacttgtgcgtggtacaaaggggcgcttgaagcaaatgctttacttgcagcgggttatggtgcagtcattgccagtgaggaagaccccgcacgtccgctcaacaccttagagttgaaaggcttaacccctgttgatgccacgcaaacgccattaaaaaccgagattaatcaagccttatttaatgggctaacaccgattacggtggtaaatcatcgggtgcaaattatgcgggcgattaccacttacaccaaaaatcctgccaatgtggacgaccccgcgtggcttgatttaactaccattcgcacgatggactatgtgcgtaaagcggttgaacagcgtgttgccttgcgttttccgcgttcaaaactgtctaaacgcacaccgccaaaagtgcggtcagaaattttagatgtgttgtatcgcttggaaaaccaggaaattatcgaaaatgtggacgcacataaaggcaaattattagtggtgcgtaatggacaagacccaaaccgcttggatacgcaaattccaacggatgtggtgaatggcttgcacgtggtggcaaatcgtattgatttaattttataggagtaagtaatggctgaaaaatatgcaggctctgcggtgttagaagtggacggcgtagagattgagattgccgatctaaacgtaaccaaacaaacagggcgtaaattggtgaagacaatgaactccgaagggcgtgctagaggctttgccaaagggattgccacttgggaaatcagtttaaccgcagccctcccaattgatggttctgaaattgattgggcggaaattagtgatgccaaaatcactatctatccccttaatcaagaagataaacgtacctcttatttgggctgtttcactacgcaggtgggggaaaaatacaccgtagataatgaagctgtgattgatattcagatgaatgcacttaaagaggtgagcgaataatggacggacatttacttttaggcttgcccgttgatggtaagcgatattttgattttaaggtgcatttgctcacattgggcgatgagtgcaatgcccttgagatgattgcgaatcttggtattgctacaggtgaggctaagccattaagccaagcagaaaaaatgctgatggatttagcctatttatgccaacaagtggaatttgttggggtggataaacaatatattacccctgaatacttgctaaagcgcctggcaacagatgattatctcctgattgctgagactattttggcattgcgaaaaaagcatatcgccgctggggagagccaacaccaagaaaacagccacgccccaactgctatgacttaaaggcggcagagcaacattatcgaagtgcggtggtttttttagcgaaattaggctttacgccccagcaggtgcgagaaatgagccatttagaggtgtcggcttgggtggaaagtctgttgcaatctcaaggggcaaaatcacaagcgaatggcataagcaaaggcgatacagtgcattacaaccttgtacgccgcaggcaacaacaagaggcgtaagcctcttttttttatgggtttaaaacaaatttaataagggtttaaaaatggcaaatctaaaaatgtctttatggcttaaagctaaagattttgcaagtggcgttgtcgataaaatgcgtagcaatgtcaataaagcgaataaagatattgaaaatcaagcggtgcgaagcgggcaaaaacagcaagaaaccgtaaagcgtacggctcaaattaccgagcaatcttatcgccaaatacagcaagctgctcgagcaaggcaaagtttgggaatgcggagtgaaaatgctatccagcgtgaaattaatcaaaccattgccgcttatcaacgtttaaaaaccagtggtgtcgcctcaagccgagaaattgcccgtgcggcggtaatagctaagcaaaaaattgcccagcttaatgcggaaatgggcaaagtgtcgacagggcaacggttggggaatgttgttggaaaaaccatggctattggcggagcggtttatggcgtagccagtacattaaagcccgcaatggataataaaaagcaatgggatcagaatgttgctcaagttgcattaaccgccttcaatgatcaagatgcggattatatcaaaacaacaggtatcgcacgcgtaaataaagcagcatatgaaacaaccaaagccgttggtgcgggaaccacggatatggcgttatccgcattagatggaatgattaaaaatggtttatcttttgaccaagccgaagcaacattgcctacagcaatgaaaatgatggttgcgggacaaacagacggtaatcaagtgggtgcacttcttcaggtcttgaaaaattatggctttaagggagaggatttacaaaaagccttagaggttactttgcaatctggttttgatggtaagtttgaggtgtcagatatgatccaacacctacctaatttgctttctatttctaaaaatgcgggctttcacggtttagaagattacaaatatttactttcaatgacacaggtggcagctaatcaagcggggtcaaatgatattgctgctaataatgttgccaactatttgaataaattaaatagtgtcgataccgcacaacggttaaaaaaagtggatatttccaataaaaaaggtttgcaaggcattgatttagaaaaatcctatcagcgtggtttagccagtgggaaaaatgcttcacaggtaatggtaagtattgctgaaacgttgcttaaaaacgatcaggaatatgtgaagttacagcaaaaactgttgcaaaccaaagatgaacagaaaaaagagcttatcaaagcccaaatggatttaaaaaaaggggcggtgcttggtaagttgttgcctgatgtacaagcaaaagcagggtttaatgcggtaacaacccagcaagaaatggataagtatcaagccaatcttgaggacggcaaaattggcaaaaatatggataaatctgtcaaggtgcttgctggaacggatctagctaaagaagagctagccaattccttaaataaatttagtcaaggcgaagtcaccggctggttaaatagtattgaacgtaaaattaatgacgaagtgatttctgcacatcaaaacggcaacgggcaaatggtgggtaatttaggcttagcaatggatgtgggaaaatcagcagtgggctatggttttggtggctgggcgttaggaaaaggattatctggcggtttggggcgagcaggcgttggtgcggcgacgggagcaggtttaggtgttgtacccgttttaaaagcggtaggtaaagtgggcgttgttggcacaatcgcaagcttaactacatcacctgaattagatagtaaatctcaacaacttcttgatttacaacataaagtacgttcaggaacagccacagaggaagaaaaacaagcgttaatgcaacaaattaaccaatctagagaagaagcaaaattacaagacgcactttataacacaggtaattcacttggtgcgtattttacccgtaaaagtgtagaaaagtcttatatggcttatctcaatagccgtttggaaaaaggtgatatttcggaagaggttcgggctcaaattgaagaacgaaatgcctattatcagaaagagcaggcaaattcatttcgttttcgtaaaggatcaccttatgttgcttcttctcattttagtgagcaagctgatcaaagtgcgactcgcattgcaggccttagctcgcctatcggtttgacaatgccaaccgcggagggaggaacacttgcaaaacttgagcccgccttgtcgaacttagccaattaccgagctgactttgagcaatttgggcaaaccttgagtgatgccttaaaacaagccattgagagccaaaattttgtgatccaaaatcaaattaaggtggatttagatggacgaattgtggctgaacaaacttcagaatatcactatcaagatttaaaacgttgggggtaaaaatgaaaggttggacaatgcctattcaacgcgccagttatcgtggtgtgcgttttgaggtgatttcggtagatgatgaattaaaccgtgccaccattgatcacgcctacccttttgttaatggggcggatattgaggatttgggtttaaaccctcttacggtacgaatgcaagcagtgttttatggcgagggctattacacggatttcaagcagtttttaagtgcgttacaaaaacaaggggcagatgtgctagtccaccctattcggggtcggttgccgaatatgctttgcacttcggcaaattttcgccacgatgcggaaatgattgattatgtggcgttagatttaacttttgtagaaagtacacctgccaagccgatttttgtttttgagttttcttttttggctaaaattgatgaacttttaacacaattggaagattttattgatgaggtattagcgttttttgctcaaatcatggaggtggttgcctttgcgatgaatgtaaaatcacgtttattaggggcttttggtgcattacaaggttgttttgaacagctttgtggtttatttgatatgggcaaaacttttttttcattgccttctacatttggtgcaatggattttaaagcaaaatcttctcataccgctaaagcaattacacatattatagagcaagggctaacccaagttgctcagcgttctgatctcacaactaaagcaaaatttgatgaaacaataagaacggtaaagcaaattcaagccattcctcaaaatttactttcaggtaaaaatatgaatttatcgcaacaacaggggataaaatcattaacaatgtcattgtcaactgaaagtattgaaccagtgcatttgttgatgcaattaacttgtacagcgacgttaattcatttggcaacggggtttattgaagacgaaacattattgccgcaagagattgactatattacaacccttataaggactcatattgtgtcaaccttgcaattattgcgtcatcaagcccaaaaagagcaagcaaattctgcactaaattcaaccgcacctaatactggggtttataccgctactcagcaaattgcggagagattacgaactttatcccatcattttacccagcttgcaatttcggcgattaatcgtaaaccaccattaacggttagggttgtaccatttaatggcacgattcaacagatcgcccatgcgttttatggagattatcgccgttccgatgaactgctacgcttaaacccacaagttaggtttccgaattttattgctcagggggagttattaaatagttatgtcaattaattatccttatgaaaatgatgtggtggttgaaattgcgggacagcagcataaccactggaaaagctatgacattgacagtgattttttaatccctgcggatgcctttcgttttgaaatcggcgtggcttcagagcatacccacttacccgatttttcggggcaagaagtaaaagtgcggatcaatggcgaggtggtgctgacgggcattgtggacaccacccagcacgggattagcaaaacgaaccgcacttttagcctaaatgggcgagataaagccagcattttagtggattgctctgccccgataaccaatgtgaaagggctaacggtgcttgaggcggtgcaaaaaattgtgaatccgttgggtatcacaaaggttgagcttaacgccgaaaataatcccactttagataaagtcgatattgaagtgggcgaaaccgcgtggcaggctgctatccgttgtgctaattctgcggggctacatttatggtttgatgcccaaggtacgctaattgtgggcggtgcggattactccacaccacctgtggcaacgctatgctgcctaaaagatggtaaacgcaataattttgagcaagcagagttgacctatgatgtatcacagcaatttagtgagatcacctttttagctcaacgccacgggcgagctggggacgataataaaaacgatttaaaatgggtgtacaaaaacgaggcgatgaccacttataagccgaaaacggtggttgtgcctgatgtggaaaatttggcagcgttgcaaaaatgggcgaaaaaatatctctcagacagcattttagaaggctttacgctaactatcattgtaccagaccataaaacccaaacggggcaattatggcaaccgggtcagcgtgttcacgtgatttgtgaagaatatgatattgatgccatctttttcttgataggacgacgttttaccctttcccgttcaggcggtacacaaaccgaattacgcttaaaacaagatggagtttggacacccgatgcttatgttggcaaagcggaaaaagcccgcaaacggaaaggtaaaaaaggtaaaaatgggccgttaatggcaacaacaggtgatggtaaatgggagatagttaggggtaaataatgcgtcgatttagtcaagcaatacaacaaaccgcacaaacgacattaaatggcgtgcgtcaggcttttcgtggcgtgctaaatttagtaaacagtgcggataatattcaaaaaacgcaagtatcagggctagctgacgagaccttgcaagatgtggagctaatgcagcattttgggtttacctccgttcccccagctggtacgcaagcggtgattattcccatcggtgggcaaacctcgcatgggattgtggttgcaaccgaaaatggggcgtttcgggtcaaaaacttgcaaggcggtgaggtggctatctacgaccaaagtggctcaaccatcgtgcttaagcaggggcggttaattgaggtggattgtgatgattttgtacttaattgcaaaacctatcaagttaatgcgacaacgggggcaaattttgatacgccaaagttagagaccacgcaagttttaaccgctcaagggaaaattaatggcaacggtggtatggcggtgcaaggtggcagcggggcaacctttaacggtgatgtgacgcaaatcggtggtaacattacgactgatggcgatgttaacgcaagcggcaagtctttggttaatcatactcacagaggggacagtggtggcaataccggctcaccacaataaatctatttacaacaataaaaagcggtgtggaactccatcaccgctttttttgtatctgttttacgtatatttgtcagtatggacagagagttaagcccgcttactggggactatacaagtaagacaatcagtacgctcgctaatgcggcgtatatcagattaaccacacctttaggctcttggtgggcagatgggcgtgtaggctctctgctccacttaattcagcgtgaaaaagacttaacccgtgttggacttatcgcccaacaatacgccgaagaagccttacagcccttgcttgatgatgggcgagcaagtcaaatccaagtaacgcaccagcaaccacataatggctggttaattttacatattgaaatcattgataatcggggtgaaacatatcgctttaaacaccctgtaaaagtcatttaacgggagtttaaaaatgtttgttgtacccaccttagatgagataagagcaagcattttacgcgatatgcaagcccttgatcctcaagccgatgtgagcgtagacagtgataattacgcccgtgcctcaagtttagcagcggtggctgaaggtatttatgcacatcaaaaatggctgattaaacagttttttccagataccgccgatacggaatttttagagaaacacacgggattgcgaggcattcgccgccgtaatgccacctatgccagcggacgaggggcaaccattacggggcaagaaaatgccgagatccctgcaggattgcaaataaaaacggaagataaccgcttttttgagaccctagaaagtgcggtcatttctagcacgggttttgtggttgtgcctgttcgctcccttgctacaggagcgggacaaaatattaaaacccaaaccaaaggcagttttatggctgccccagttggtgtgcaaagtgaagtgatactcaatgaagtcattggtgcgacggacgcagaaagtgatgcttcactgcttgagcgtttgcttgagttgatccgccgtcctcctgcaggaggcaataaatatgattatcgcaattgggcgttatccgttgatggcgtaacggcggcttatgtgtatcccttgcggagaggattaggcacggtggatattgccattacggcagacaatgatgtacccaatgaagaaaccattcgccgaacacaagcctatattgatgatgtccgtcctgttacagcgaaagaaagcaaagtggtaaagcctgatgtaacgaaaatccattttgatattcaggtcaaaatcagcggcattacgcttcaagagataacgtcagcaatacaagccgcattggctgattattttaatacgctaatccccggtgatagcttgattgtgtcgcaatgcgaggcagtggtgaataatttagtgggtgttgtggatcgcaaatttattaccccaactgcgaatcgtaccgctgacgttacccacaaaattgagtggtttagattggggaacgtgaatgtgtcggagatgcactaatggctaatgattacaaacacgcccttgctcagctctatccgcctgtttcctacaatattaacggtaaacaatttttagcccaatgtgaggttgatggaaaggtttttcaacgtttagaacagcgtgcaacggaagtgttaaatgtgattaaccctgaaacttcggggcaaatgctcgctgattgggaacggatttgtggaataaaaaccgatacccaaaagacctacactgagcgagtgaaacgggtcattttgcagcttaatgccattggtgggttgtctatcccctattttatgcaactggctcaaagcattggctatcaaattgagattaaagaattttcaccattgcaacaggatttgcctgttcccggtgacattgtgcaatttagagacgaaccgcaagaaagcctgatttttatgtggcgagtttctgttttaaatggtgatgacaatattgtgtattttcgagcggggcagtctttagcgggtgagcgactagttgagtttggcgatcccattattgaagccttttttaaagagttaaaacccgctcatacttactgttattttgcatacaaaggttaaaaaatgaaagatttactccctaaaattgatagccaagatggcgaatttcaaaatggcgacccagccagtggcacacaaggcacgcgggtaactgccgaatggttgaatagcgtgcaggctcatttgcgagatgtaggcgaagaggtgaaatatttgttattacaagcagggcttacacctatcccaagcaaaaccacacaaatttatgaagcgattatggcggttattaatgccaaccgcagaaatggcaacacaacccaaaaaggggaaatccaacttaccgacagcatcaatatggcatcaagtgtgtttggggcaagtgcgttggcagtaaaaaatgcctatgacaaagcggttgaggcggataatcacgccgaaagggcttgccatttggctgaaagcaagcaatcccctgccacaacattagccggctatgggattggtgattttaaggtggggacatccaccggtgatgccaatgattgcaagattgacggcaattattattttgccagcgggcaaaatttaccgagtgcgggggcgtggcatattgcggtgatgagtggcggacaaactaacgctatccgacaaattgcccgcaaagccaatgagagcaaggttcaaacccgttattttaacggcacgtcttggagcgcgtggaaagatgtaggcggtgatggcttgcccgttggctcagtgttggcatttcctgtagccgtgcaaaatccacaaggttttttgaaatgtgatggctcaacctttgggagaacaacctatcccgatttataccgcgcgttaggcaatagcaacaaactgcctgatttacgccgctctaatgtgggaatgacggcgtattttgcgacagataagattcctgagggctggattgcgtttgatgaaatcaaggaaaaggtaaaaaaagagacctaccctgagttgtataaatacctgattgaaaaatataccagtatagacaatgtccctaaagcggaagaccgttttttgcgtaatgctcataatgggttaaaggttggagatgtacaactcggttccttaatcggtacggattcgatagacggaaacggggcattttcgccttatgtgaaagctattaaaaacacttaccaagaaaccgttgaccaagtagggttcgatccgttgctgataggggacattggaaacggaagaaccgctgtcaataacgaacattctccggacagcggacaacctgaaaccaaaaaacaatataacgccgggctttcgtggtcggtaggagcgggcagaaatgaagaccttaatcaaccaatccaaaataacaaaagtggcaacggtcattttgtcggcgttactcgcccgaaatctcttgttttaaaactgtgtatcaaggcgaaaagcagttttgatgaggtggtattttggattaaagcattcggtgcggtggaaaatcaaggtgttttggacgcctctgctatcgttcaagaaatgcaggattttaaacagcaagccgaggaaaaaatacaatccattaccttgcagaaagaagagattatgcacgctatacaagaggagatgggaaaatcagattattcccttgttaaggtttgggaggggaagaatatatatacagagggttcaataaatttaagtgaaccttgttttggctctactgtttttctgtttgcttacgctgatagagactatccaagggaattagttgtttttagttttgatgttcctgataaacatattgatttaaaaagaaaaaattcagatcaatacacattctatggtattgctcattacacaagaagcggtggtcatgatgcatctcttacacatgctaagattaacattaaccgaaaaacaggagatcaaatcaaatttgaggatttttatgcgggatataatatttacttaagagaaatctatatcaaaaaaccaaacaacaggaaagcacgatgaacatttactttcaaaaacaacaattaagcaattatcaaatttttccaatccctcaggatatagagaattggattgaaaaagacgttgacgaaaaggaactggaaacgcatgttttggtggaatttaacggcgagtatcaatgggtcgagaaatccgccgacccgatgacgaaatggaacgggaaaacatgggtcgttgatgaagagaaaatgaccgcacatttaacccaagtgcgggcggaaatgcgagagaaaatcaatgcgttgcgagatgaaaaaatcaatggcggggtatttgtggaagcggtgggcaagtggattgatacggacgctacggcggagcggaatatcttatccgtcaaagccagttatgatttattcggtgatatggagattgcgtggacttgtgcggataactcggttttgatgataaataaggaaaaattaatgctgatttggcaggcgttaatgaatgctaaaacaggtaatcatgctaatgccttgaagcataaaaccgccatggagcaatcggacaatccggcggaatatgattattccagcgggtggacaaaatgttataacgattatttagcggaacaaggcaatgagtaaagtctatttagcactgtataagggcaacggtggcagtttgtatgaccgagtcatagactggctgatccgaaaaatcactaaggggcaatatagccattgtgaaattgccattgagcaaacggcgtttttaagtggcgattattatccgtatatcacctacgattgctacagttcaagtcctcgtgatggtggtgtgcgacacaaagtgattgaccttaaagacggcaaatgggacttgattgaactgccaaacatcacggcagagcaggtcaaacgctactatacccaaacccaaggcagaggttacgattggtgggggatgttggggattgcctttggtatccagcaaaaacgctcacgctacttttgctctgagtggtgttttaacctaatcaaaaatggtgacgagggctggcggtttagtccaaatcatttagcggcgatttttagacggggagcaaaatcagattattccgcacgaagttgatattatttgggaggggcaaaatgaagtaaccgtttagagcaaaagaagaagcggcgatgtggtaggctctgacctctaccacatcagcctaagcagatagtgcctgcatagacccgagaccgctttgtctgaccagacgggcggattgtaacaaaaccgcgtaaagtgagaaagtctatgcaaaaagatttgcaagaaatacggtgcaagtgctgtaaaaagcttcttgcacgcacaaaagataatcaatatttagaaattaaatgtgtgcggtgtaaaaccttaaacacatttaaacctactcgttaaacaactcagagtgtccgaatgccttgagcgtcagaacgccataatttaaggataaattatggcaaacaagaaaatcattgtttgggcgttatttgatagcggcaatggctgctatacccaagccgcccaaccattccctaacattgaaatctatcctatcggcattgatattgagcgtaaaaatcggcattttttaccgctgaatttagcggattttggtcggttgtttggtgataatacgctgtttaatcagctagatagcctccctaaacccgatgtcattttagccagtccgccttgtgagagtttttccgttgccaactctattaagggcgggaatgtctgttggcaatggcagggaaatacacgctttgctattcgccgtcgcaaagattttgacgcggcagcggttaaaaagcgacgttatcgttatgagacctcttttttgaatcgaattaatggtgagctttgcatttataacaccattgagattattaaacggtatcagccgaaaatttatgtgattgaaaacccttatgcgagccgcctttggcactatcttgatgagattttagcctttcctcttccttatgcgaaccctacctattatgggaattatggctggccctgcaaaaaggcgactaagtttaaaagcaatattccgctaaatttgcgttatcagcattatatttcgggcaaaacgatgtttgactgtttacacagttataacgcccgttcagccattccgttgccacttatccacgatatttatcgtcgtattattgaggtgttaggaggtaacgatgcgtcattttagtcaagcaccgttgccgtttgtcgggcaaaaacggctgtttttaaacgcctttaaacaggttttaaatgacaatattcaaaatgatggcgaaggctggacgattgtcgatgcctttggcgggagtgggctattaagccacgtagcaaagcgaataaaacccaaagcacgggtgatttacaatgattttgatggatacgcagacagactaaaacacataagcgatacaaatcgtttacgagctgaactgattcaaattgttggcgatattgtaccaaaaaacaagcgattagacgacaataaaaagcaagaaatcattaataaaatcaatgattttaatgggtttaaagacctcaacaccattgcaagttggttgcttttcagtgggcaacaagtcagctcatttgaggagctatttagcaagacattttggaatggaataaagctggctgattatcctagtgcagaggattatcttgatgggcttgagatagtcagcgagccatttcaacagtttctgcctaagtttgccgacaaccctaaagccttgtttgtgttagacccaccttatctttgcaccaagcaaaacagctataaaatggcaaattattttgatttagtagattttttgcaacttattgacctaacacgaccgccttatgtgttttttagctccactaagtcagagtttgtgcggtttattgcgtatatggtgcaggcgaaaaaggataactggcaagcctttgatggagctgagcggatagtccttcaaacatcgttaaactatcaggttagctatgaggataatttggtgtttaaattctaaaaattaaggggcgaacgcccctatttttcaatgcccgccttatagcctgcctcataagccgcacgcatgaggcgtttgatattccacacgcccatatcataaaaatctaaatggtcactcattcgggtctctaatgtttcaatatcccccacctcttttgcaatggtttctaatatttttgcgatggttttttcagttgtttttttcattgcttattctcctcttaaaatgtttacgattttgtcagcgatttgctgggcggcaatgtcaaagttagtctcgattgaaacgcgttggcgacaatgttcagagtgttcaaccagcgtgccttgtggcatataaagtaaataaattgttggctcattttgataactatcttgacagacttgaaagcggcgtttcccttgcacaaattccccatttttaaagccgtgatggttttcaagtctggtggttaagtgttgaataaatgctcgtgtattaaatttcatttttatgcccctgttgttttgtgttggggacatcattgctcgttggggacgaggagtaaaggggaaataagcagtagttaagctgactgactaacaatgtagctggggaggtatggaggtctaaatgataaaaaatttgaaataattttgcataatctgagactcaatagctatgcaaaataaatttaaattttatgcgaaatgttttgcgattttataatttctccaattgttaaacgtggagacagtgaattgaaaggatcttgaaaaacaatctgcatgtcttttttcaatgcttgagctttttctttcgataaagtggcgatattttttccgttaaattgtaatatcccctgataatcaagaatttgcataatagcacgtcccaacgttgatttacctgaaccggactcaccaacaataccgagggtttcaccgacttttaactcaaaagaaatatctttaacagcatggaaaacatttttcggtttaccgaacaatgtgcgttttagcacataatcaatatgaatattttgtccattgaggaggacaggtgcattttcagccaacggatgttttaaatccgtagggataggcgtcagtaattcttgtgtatagggatgatgaggttggttaaatacttgttctgtattacctcgctccacaatttcaccgttttgcatcacacaaacgtaatcactgtaacgacgaactaaacgcagatcgtgtgagatcaaaatgatcgccattcctatatctcgttgtaattcaagcattaaatcaagaatttccgcttgcgttgtgacatcaagtgcggtcgttggttcgtccgctattaataaatccggtttattaataattgccatcgcaatcatgatacgttgtaattgaccgcctgaaaattcgtgtggataacatgccattttcttttccgcttcgggaattttcacttttttcagcatatccaatgcgtgcttataagcctccgctttactcattttcggatggtgaatggcagtcgcttccgcaacttgttcaccaatcggcaaataagggttgagtgaagtcatgggttcttgaaaaatcatcgccatacgatcaccacgaattaatcgcaactctttttctgataaagataatatttctttgttttcaaataagatttttgagtcttcactgtaactgatgattttttgcggcaacaattgcataattgccatagaagttacagatttaccggatcctgattcgcctacaatagcgagagtttgtcctttttctacctcaaaagaaatattacgaacggcgtgtacgacttcttcatctgtttttagataaacatttaaattttttacatcaagtaatttcattctattcattcctatttatcttttggatcgagggcgtcacgcaagccgtcaccaataaagttaaagcaaaataatgtcagacaaaggaaaaaagcaggaaatgcaatcaaccaaggcgatgtttccatttgtgcagctccatcgctcagtaaggctccccaactgctcatcggttcttgtgtgcctaaacctaagaaactgagaaaagattcaaataaaatgagcgaaggtacttccaacgaggcataaacaacgacaattcccaaaacattcggaataatatgtttccaaataatttgacgacgggaaacaccacaaacaatagcagcctcaacaaattctttgttttttaaactgagtgtttgcccacgtacaattcgagcaaggtttaaccaagcaatcataccgatagcaacaaaaattaagaaaatattctggccgaaaaatgttaccaacaatataacgaaaaacataaaaggaaaagaactgagaatttctaatgtccgcatcatgacaacatctacttttcctcccacataacctgagatagcaccgtaaatagttccgatcatcacagcgataaaagctccggcaatgccaaccatcagcgaaattcgcccacctatagcaatacgcaccaataaatcacgtccggaggcatctgtcccaagataatgtccggaaacaaaatcaggggcgacactcatcatattccaatcagtgtcatcatagctaaaaggaattaacgttggtacgaaagtgataaacagcaacatgcaacaaatgataattaaactgataactgctgctttattacgaaagaaacgacggcgtgcattttgccataaactgcgtccttcaatgatagtctcacaagcgttttgcatgatattttcttccgattttgagcggttttgacgattagacaacatgagatctccttatgaatagcgaattttcggatcgataaccgcatatagaatatcaactaatgcattaaaaaagatggtaagcgtccccactaatatggtgaggctaagtactagagaataatctcggtttaaagctccattgacaaacagctgccccaatcccggcaacccgaatacactttcaatgaccattgaaccggtaataattcccacaaatgccggtgctaggtaactgataacaggaagaagagccggacgcaaagcatgtttgaaaataatttttttcaatggcaatccttttgctttcgctgtacgaataaaattggaatgcaatacttcaatcatggaacctcgtgtaatccgagcgataccggcaacgtaaccgatagtaagagaaagaacgggtaaaaccatataataaagttgaccgtcgttccaaccgccggcaggtaaccactttaaccaaatggcaaaaaataacactaaaagcggtgcaaaaacaaagctgggcatgatcacccccgtcatcgcaaaccccatcacaatataatcccagcgactgttttgtttgagagcggcaaatgtgcctgcaactaagccgataatgactgagaaaataaatgcgacaatacccaatttcagtgacacgggaaacgcagaagcgattaaattatttacgctttgatctttgtatttgaaagaaggtccgaaatcaccttgcgagagatttttcaagtaaagcaaatattgtttaaagagcggttcatttaagtgatatttcgcttcgatattcgccatgacttctggaggataagtccgttcggaagtaaaaggactacccggagccaatcgcatcagaaagaatgaaaatgtaattaaaataaacaatgttggaagtgcttccattattcgttttacaataaatttcaacatcaagaactccaaacagattaaatgagaaaaagtaaatgttatttaaaaataaatcgtcaaattcccctaacctaatgttatcaattagggaaatttgacgggataaataagtttaatgtttaataatataaagatttctcaataaaataatatcttgaggatctttaccttcatagcccttaacataaggtttcaccaaacgcgggttaacatagttatatatcggtatgataggagcatccgctgccaaaatcgcttcggctttagcataagctttcatacgatctgtcgcctcggagaattgataagactcattcaccgcttggtcgtaggccgagcttttgtaaaacgctaaattgttacttgagttggagagaaaataattgataaacgttgtagcctgattgtagtcagctgaccaaccggcacgtgcaacatcaaattgtttgttgtgacgactttcaatatacgttttccattcttgattttccagtttaacatcaactaaaccacccgtattatttttccaaactgatgccgcggcaatagcaacttttttatggttttcattggtgttatataaaatggtaaatttcaatggattcgatttactgaaaccggcttctttcaataattgaacggcttgctgattacgctctttcattgataatttagtatattcaggttgctgaattgcaccaccttccgcaatataggtcggtgtaaacacgtatgtaggtatttgcccctgtcctaataccttatctgtaatgatattacgatccaacgctaaattcagtgctttacgtacccgtaaatcattaaatggtgctttcgtattattgatctcatagaaataagtacccaatgtacgtgaagtaaacacttgatccggcatttcagcttttaattttgggaattgctccggtggcaaggcatgatctgttatctccacttctcccgcacgataacgttgcacatccgtacttggattttgaatcgctaagaatgtcgctttatcaatcacggtttctttatcattccaataaagcggattgcggacaaattcaattttttcgttgataacgtgtttcgtcaatttataagcaccgttacctacgtaattttctactttgacccaagcatcaccgaatttctctataacatgtttaggcaaaggtaagacagagtgatgtgtggtcataccaggtaaataaggcactgaattgcttaacgttaccacaaaagtataatcgtcaacggcttttacaccgagagaatctacttttttcttcccttcaataacatcttgtgcattttcaatttgcatgtacgtcaaataagaagaataaggagaagccgttttcggatcaacaagacgttgccatgcaaagacaaaatcatgggctgtaacaggcgtgccgtcagaccattttgcatcatgacgtaatttaaatgtccattgcttaaagtccggcgtactttcccacgaagtggcaacaccaggctgaggattaccgtcagaatccaccgtaataagtccttctaaaacctgtaaaacaacctctgcttcaggtattccttctgatttatgcgggtcgaaactttgaggttcagctccattattgatgacaatttcttgctttttagccaacacggtaccagccggaacactggctgcaaaagcagatattgaaaaacctaatgccacggttgtggcaacaagagtgcgggttaatattgtgtgcattgttattctccattgtgattgttgtttgctctgctattaatacatgaaaagattgcttttgtaaataattcatactagttagatagtaagctaattagagtgaattattctagagggcaatgttacatgaattaaattcttatcataataaagtgcggtcatttctctaagtaaagatcgctgagtaaatagccaccttgcggtcttttcccttcataaccttttaatttcggatttttaataaataatccggcgtaatgataaatcgcgataaaaggatgatgtttgcctaattcttcttcagcttgtgcataaatttccgctcgtttgttttcatcactttcgttgtaagatgcttcaattaattgatcaaacttttcgcttttaaagccgattttattttgcgaactattggaaagaaaatatgtcaaaaacgtgcttgcttcgttgtaatccgcagaccatgctgcaaatgccaagtggtaatttttctgattttttgtatctaaaaatgttttccactccatatttttcagcgaaatatcaaccagaccgtctaaatttttcttccacatagaagtaaccgcaatagcaatattttttagtccttcgttagtgttatacagtaattcgcttttcaacggatttgctttactgtaaccggcttcacgtaacagctttttagcttcttcgtttcgttgtgcttgcgtccaattagcatattccggttgggtgattttttctcctgcatgaatatagaacggtgtgaaacggaaagtaggtgtttgtccaaagcctaatactttctctgtaataatgttgcgatcgacggctaaatctaatgctttacgtactttaatattatcaaaaggcggttttgccatattcatttcatacataaacgtacctaatttacgagagctatagatttgcgaatcgtattgagcacgaaatttaggatcatgataaagtgattgaggaatataagctatatccaattcgccggaacgataacgagctccccctgcactttccgttaaaatataaaaagtagccttattaataacggaatgggcgttatcccaataggctggattacgttccaaagtgattttttcatttaacactcgttgtgaaattttataagcaccgtttactacaaaattttccggttttgtccaatcatcaccgtatttttcaacaacagcacgatttactggataaagagaagtatgctgcgtaagaaggacagcataaggtacgggtgcatcaagggtgagttgtagtgtattatcatctaatgcggtaactcccaaaaattccggtgatttctttccagcaataatatcatctacatttttcattttcatgaagccaaggtaacttgcataaggtgatgcggttttcggatcaacaagacgacgccaagcatagacaaaatcatgtgcggtaagagaatcaccattagaccacttaatatttgggcgtagataaaaagtaacggttttaccgtcagacgaggtatcccagcgataagcggcaccgggaataatattaccgagttcatcggttttcaccaatccttcaaataattgttcagctattaaaccttcccccgatccttctattttttgtggatcaagggtagcaacttcagcagtaatttgaatactgatttcctgtttatccgccaattttgtaccttgaggaacttgtgccgaaaatgcgactgaagaaccgacaagtagaaataagcctaaaagtgcggttctatagtttttatattttaactttgtccatatattgtgttgcataaattttatccttttaagtaagattaaaataataagattttcattagtaaaatatttatgcgatgaagtaaagtatttttacaaattttttgtaatttttaattagcaacctaattactatttttgcattttcaaaaatgtaggagtagaattccgacatcttcaataattcatcataggcggtatttatgcaattgagacgtaaatacatcgcctcgtattgataggagcagtatatgcaatttgcgattatcggattaggtaaattcggaaaatcagttgcacgagagctgtataagctgggtaatcaagttgtgggcatggatattaacgaaaaaaaagtggagcaatgtagccattttcttagtgcaagtttaatccttgatgccacggataaaacagccttgcgagaacttaacattcaagagtttgatgcagtgttggtcagtatcggtgaaagtctagaaagcaatttactctgcacacttaatttaattgatctcaaagcaaatcaaatttgggcaaaagctaaaaatgcggcacatcacgctatactttccagtttagggattcaacatatagtaagacccgaaaatgatatgggtattttagtcggtcaatctatgaattgccctagtgtaacccactgtattccgctaggctcggatctctttttaattcatttccttgttcaatttcaaactactattaccctcggtatgctgaaaaaacgctataaagatattgttattaccgctattcaacgaggagaacaacttattagcaatccggatgatgaaactgaaatacatcgtcaagaccatttgctgatcattggctatttaaataatcttcgcactttaaccggcgaattaaataaaatccaaaatgaaatttgaacatatcaacacaaagccaccctatgtattagcgggcggttttctctttatcattttaattggcacattattattggaattaccctttgctcaccataaaagtatttcatggctacatgccttatttacttcaacatcagcggtaacggtaacggggctaagtgtcgaagatacagcaaatttcaccctattcggacaagttgttttaatgtgcttaattcaaattggcggattgggatttatgacgtttgctatttacatagcaagacgaatgggtgccagaattggcttattcggcaatgcaattgctcaagaagcactgggtgatgtgccttttaatttacttctacatactgccaaaaacgttctaaaatttgcactgacttttgaacttatcgcaatgattattcttactgttcatttttatggtgatgtttctttttttcaagcactgtatcaaagtctgttttacagtatttccgcttttaacaatgccggttttgcactgagttcagaaagtttaatgccttatgtggatgacattgttgtcaatatagtcatcaccgtattgattattattggcgggttgggatttgtggtactcatggatatcaaaaatcaacgccaatataaaaaattctcactaaatacgaaggtagtactttgggcaacctgtattttaaatatcgtttcctttctaatattttatattttagaacgacaaaacccgttaacatttggaccgctaagcgaaacaggtaagttgtttgccgcttggtttcaagcgataacaccaagaactgcagggtttaatactgttgatacggcaggattaactgatgccagtagtctgctgactatgttcttaatgtttattggcggaggttccttatccactgcaagcggtataaaaatcggcacattctgtattatagtggtagcgacattcgcctatttacacaaagaatcccatgtcaatttgtttaaacataatttgcctgatgaactaatcaaaaagtcctttgctttattttttaccagccttagttgtattggtattagtagctttttactcttggcagttgaaccgcaatttcatttccttgatgttttatttgaagttgtttcggctttaggtacagtcggactttcacgaggaattactgctgaactttcaccgttcggagagtcaattttaattatcttaatgtttatcggtcgagtaggattgctcactatgatttatctcattatgcaaccgcactccagtaaaattaaatatccaaaagaatatatacaaataggctaaaaaataaagggaataatttattcccttattttcctaaatttaatctgttttgcaccgcactttgctcaagtttaacgacaaatatacaaagtaattttcctctaagaatgaaaaaatttatgctaacaaagccaaaaactcattttcactcagaatgttaataccaagctcagtggctttagttaattttgaacccgcactttcccctgcaataacaaaatccgttttactcgaaacactgccgctaactttacagcctaattgcaacaagtattcttttgcctctgaacgccccattttcgttaacgtaccggttaatacgacggtttttcctttcaaaggattgtcccgcacctctttaacctcaacgttgtcccaatgaatgccttgtgcaattaaatcttttaccacagcaacattatgaggctcagaccagaatgaacgaatacgtttagccactacctcaccaacatcttgtaccttttgcaattgctcaaacgttgcattttcaaaagcctctagtgtcttaaaatgagttgctaaatttaatgcagtagtttccccaacttcacggatgccaagtgcaaaaataaaacgagccaatgtggtttttttcgctttagctaaacttgctaaggcattttctgccgatttcgcccccatacgctccaaacgcattaaagtaacctgatctaatttaaataagtcagccggtgtatgtactaactccctttcaaccaactgttcaattaattttgcaccaatgccgtcaatatccatcgctttgcgtgaaacaaaatgtttaagtgcctctttgcgttgagcagcacaaattaagcctcccgtacaacgagcaactgcctctccctcaattttgctaataacggaatcacacacaggacaatttgttggaaaaataatagattttgcattttccggacgacgttcatgtaacacgccgataatttgcggaatcacatctccggcacgacgcacaatcacggtatcaccaatcgcaatatccaaacgtgctatttcatcaccattatgtaaagtcgcattactcacagtgactcctgcgacaaaaacaggttctaattttgctaccggtgtaatggcaccggttcgcccaacctgaaactccacattattcaaaattgtcagctcttcttgtgccggaaatttataagcaattgcccagcgaggtgctttagaaataaaaccaagttgttgttgcaagtcaatatcattaatttttaataccgtgccatcaatgtcataacctaaggaactgcgtttttgcttaatagtgcggtagaaatccaacactttttcaatcccatgacataattgaatttcattatttaccggtatgccaatagattttagccattgtaaacgagcaaaatgtgtatccggtaattccactccttctgcaataccaataccataagcgtttaacatcaaaggacgttgaccggtaattttgggatcaagttgacgcaaagaacctgcagccgcattacgtggattagcaaatgttttttctcctttcgctaaagctgttttgttcagtttttcaaaacctgcttgcgacataaaaacttccccacgcacctccaaacgagtcggtggattatccgttaataattgcaatggaatattacgaatagtacgaatatttgccgtaatatcttcaccggtcgtcccatcgccccgagttgcagcctgtaccagctgaccgtttatatacaaaatactgactgccaaaccgtctaatttaggttcgcaacaaaatgttaaagaatgatgaacatgtatcaaacgatcttgaatacgtttgacaaaagcaaagaaatcttcatcagaaaaagcattatctaaggatagcattggaatatcatgtttaacttgagcaaaattacttaacggtttcgcccctactctctgtgttggcgaattttcactggcatattcaggatattgttgttccaacgcttttaattgatgaaataagcgatcgtattcactatccggaatttgcggattgtctaacacatgatactgatattcatgatggcgtaatagttgtcgtaattcttcaatttgttgcttgatcataaaaattccttgcttcaagaccgcactttaaatagtggctcattatacacaatcatactattttacgtaaaaaattgcccctgaaaatccagaggcaataaatcaatagaaaagtgcggtctatttttacaaaataatactaccgatcaacgccagagcaaaaccgactaaaccgattaatgtttccatcacagtccaagtttttaacgtggttttggtatccatttccaagaaacgacttaccaaccaaaagccactatcatttacatgagaaagtacggttgcacctgaagcgatagcaatcacgataaaacataaatcaaattgacttaagcctgtggctgatgacaccattggtgcgatgagagcagaagttgtggtcagagcaacagttgcagaaccttgagctatacgaagtgcggtagaaattaagaatgccgcaacgataattggcatacccgtatccgaaaacatttttgctaatacatcaccgataccgcttgcacgtaatacaccgccgaacataccgcctgcaccggttaccaatacgattgcacaaatcggacctaaggcgttatcgcagattttttcgatttgttcaaaactgtgttgttctttgagtaaaatgatagtcattaataggctaattaataaggcaataggtgttttgccgattaagcgtaaactttgtacccataatgtagaaccatcaattacttttgctactgctaaagtgtttaggaccgtgtctaacataattaaacaaagcggcaacagcaaaataaataatacttttttgaaacttgggggattttgaaccgcagtttcgttaattggagctgcatttaagaaagttttcggtagcggtaaatcgaattttttacctaagtaaagcccatataaataagtagcaaaataccaagtcggtacagctaaaatgaagccgacaatggtgagcaaaccgatatttgcacctaaaatatcaccggaagcgaccggaccgggatgcggaggaagaaatacgtgggtgacagcaaatgcaccggcagcagggaacgcatagcggaataatgaaccaccgaattgttttgcaacactgaaaataatcggcaacattaccactaaacctgtatcaaagaaaatcgggaatccgaataggaatgaggcgacacctaaagcgaaaggtgcttttttctcgccgaatttattgattaaggtatcggcaagtacttttgcaccaccggtaatttccaataatcgaccgatcattgcacctaagccgactaataaagctactgaggcaagggtattaccgaaaccgcctaataaggtcggcaggattttatctactgacataccggtagcaagtgcggttaataaactcactaaaactaaggcaacgaaagcatgaaccttaaatttaataatgagaagaagaagtaatgctatggaagcaatcaaaataaagatcaacataaaatttccctattaataaaattaaacagcagcaagcataccaccatcaacgaataacaaatgcccattaacaaaatcagatgctttagatgaaagaaaaacagtcgcaccgattagttcttcaggatttccccaacgggctgctggagtacgtttgcacaaccagtcggaaaattctttgttttctactaacggacgggttaattcagttttgaaataaccgggagcaataccattgacttgaatattatgacgagccaattctacgcacattcctcttgttagcattttcaccgcacctttagatgccgcataaggtgtaatagtgtctcgccctaattcactttgcattgaaccaatattgatgatttttcctgcttgccgtttcaccatatagcgagccactgtttgggaaacaataaatacagatttttggttgacattaatgacatcatcataatctttttccggaaaatcgcagaatgggtggcgacgttgaataccggcattattaattaatacatcaattgctccaatatgttgttcgatatgagcaatggcctgatgaacggcttgagtatttgtcacatcaaaagcaacagcgtgagccttatagtctttagcagttaattcatcagcaaccaattgacatttttcttgattagtaccatttataataacttcagcaccttgttcagcaacaccctctgccaataaacgaccgatgccacgagcagatcctgtaattaaaattcgtttattttgtaaagaaaataaatcacacatcttcttatccttatgcaaagttaagttggatttttgaaatttcatttttattgccagcacgttgaagagcggtttctaattgttcaaatggataaatttcagaaagtaagggaagcggattgattttacctaaacttaaccacttcacggcggtattaaattcctctacaaaacggaaagaacctttccagttaatttcttttgaaatgagaggcatcatattaaattgtggaattgagcctcccatcccaatttgtacgatagtacctttcgcttttgtgacagctaaacaacgttcaatggaggaaatatgacctgaagcctcaaatgaaacatcaaattcgcctttgttttgtaaatattcggaaaaatttccttcagtggcatgtaatacttttgtagcacccatttctaatgctaaatctaaacaacgctgactaatatctgaacagatgatttctgctgcacccaatgcttttactgccgcaacagctaaacaaccgataggaccgacaccggaaataaacacttttttcccctgcaaatcaccgccttgttttgctgcgtgaatagttactgctaaaggctcagcaaataccataacctcatcggaaacttcttgcgaataaggaatacattggttgttatctacaattttatattgagtaaaaccaccatcaacgtgcggattgtacattgcactaccaaaaaaacgcattgtttcacattgattgctatagccacttaaacaatatgcacaacttaagcaaggtttgcttggattaattgcaaccttttgtccttcaaataaattgggagcgttggtctttacaattttaccaattatttcatgacctaaaatcatggggtgtttgattgcaaaattacccactttgccatgttcgtaataatgtaaatctgaaccgcagatactgccacgagtaatttgaattaaggtttgatcttggctttgttcatcaaattcaatttcttgagaaatgacatcaacagattttgctcctttaactacgcaagataacgtgtttattttcataaaatatcctccaatatttctgttactggtaacatatttatttttctagattgggtaaagtttttgtgtttgattttgtgatttacgtcacattttttctttatttttaatgatttttaaaaaaagtgcggttataaaaataaaaatttaaaacaataaatatagatttaagtgttattggtaactttttaaaattttttcaggtacactaagctcaatagcgtatttattagaggaacaaaaaatgtcaaaaggaaaaagtattattttaatgggggtatctggtacaggtaaaacatcagtaggaactgaagtagcgtaccgcctaggattgaaattaattgatggggatgatttacacccaagagccaacattatcaaaatgagacagggacaaccgctcaatgatgaagatcgtatgccttggttggagcgtattcgtgatgcggcatttagtttggagcaaaaaagtgaaaagggcattattatttgttcagcactgaaaaaacaatatcgagatcaaattcgtgatggaaaccaaaacattaaatttatttatctatccggcagttttgaattagtgctttcccgtctgcaaaaacggcaagggcattatatgaaaactgaaatgttgcgaagtcagtttgctacgttggaagttccccaagctgatgaaactgatatttatcacattgatattgacgcaacttttgaggaagtagtgcagcgttgtgttgaagctatcaagcctcttttagattgatgacaagaaatgcttgggcgtagaggtgttatctaagacgtagattacagacaatatttttgccataaaagatagtttttgagctaatgctacgaaaaaatactcaaaccccaccgcactttgcaagtacagtggggttataaatagaaaaagcgtagtcgatttttaccagtatgcattgttattcctatgttttgttttaaaaataaaattctgcgtggtgtattattgacaaggcgttgcacaaaacaattccagcgaaattcccacctttgcagtaaaaatttaattctcttggtgttattcttgtacgatctattctctctatatttgcatttttcctaaagcaaaactcgatctatctcacaaaaatattaacaaataatttacaattcaaaccgagcatgctaaaaagcaatcgtttgcaataaaaatattgcatacattgcatacaatacaacatcaatgacatcacacaggagcaactctatgaaaaaaatgaaagtcgtattgaccagtgcaacagttctacttgctacattgcttgccgcttgtggtgataataacaaagcgtcgaaagatgttactgcgagcaacgttgcggcaaacagcagcagtgctgaaagtgcggtaccagccacagtgcaaagcaaatttgtgaccattgctactggcggtgcttccggtccttacaatattattgcgacgacactgacaggtatttatagtaaaaatctaaaaactaattccaaaacacaaactactggtgcatcggtagaaaatttaaacttgatggcacagaaaaaagtggaaatggcgtttgtgatgagtgatgcgttaaatcatgcgttaaatggtacaggcagtttcaaaaataaaattgagaatgtggaacaaatagcagcactttatcctaactatgtacaaattgtcacctctaaacgttccggcattaaaaccattaccgatttaaaagggaaacgggtagcgaccggcgatcaaaattccggagtcgaagtcaatgcacgtaacttacttgccggttttggcatttcctatgcggatattaaggttgattatctcggttatgctgcagcggcagatgctctaaaagcgggaaccattgatgcggcgttcttaaccagtggcttgccaaattctgccttaatggaattgcaacaaagttttgatctgcaattggtctctatcccggctgacggaattaaaaaattagccgcagataaaccgtattttaatgcgatggatattccagcgaacacctatggcaatcctgaaccgattccgacagcggcaattaaaaatgccttggtgatccgtaaagagctcagcgaagcagatgggtatttattaaccaaaaccttctttgaaagtttgccacaattgcaaaccgcacaccaagcggcgaaaggcattaacgtgaaagaagcacaggaaggtgcagttgcaccattacatccgggtgcaaaaaaatattatgacgaagttaatgcgaaataattcgttattaagttggtaagcatgaagataatgcctcgtaacggttggtttgtgctggtgccactagctgttattgggctttatcctgttcattttatatcagttaccacaaaacaaggcgaatgcatcattggtgatgatcattttgcactacgttggcgtcactccgtcgagcatcaattgtggtatgaacattatcaacgacaaggtgataacctccacctttatcaaacatggttacaaacatttggtgctggaacaccttctcaaggtgaagttgtcacccatgtgccagtgggctatgtcggttttaaacaagatgttgttttacccgaaataaattggattgtttcgcatcgtatggaagggactattttgcttgatgataaacaatttcccgtttatcaaacacttcctaattattctgcggtaacaatcaaaccagctaaatctgtaattgcaacgttgtggttaaggaaatcatgttatgactgattctgtaaaaattgacaccgcacttggtgccaaggaacaagagattttggaaaaatatgaccgtgaatcggtcactcgtcaatccagtagccaatttaataaagggttaattacgctggtttcggttttatattccctttttcatttatacaccaccttttaccccctaccgacgttaatccagcgtgcagtacacgtgggcgttggagcgatattaatcctattaatttatccggcatcgaaaaaacgtcgccaaggttctgttgcatggtatgactggttatgggttattgccggtatgagcggtatgctgtatctcatcaaccaatacaatgacattatgaccgtccgaggtggtattccaaatagtacagatattgtgatggcaatcatcactgtgctagtggtgcttgaggtaacgcgtcgcgtcaccggttggattttggtgattttttccttgctcttcttaatctatccattcatcagctcaatggattttatgccggacagcctcctcactcgcccttatgacgtcggtgatatttttggtcagctttatttaaaaacggaggggttatattcctctgctgtgggggcttccgtttcctttattttcttatttattttatttggtgcttttctaagtaaatcgggaatggggcaattatttaatgatttagccttagcgatcgctggtgataaacaagggggaccggcgaaagtagcggtaatttccagtggctttatgggcagtattaacggggcagcggttgccaacgtggtgagtactggagcgtttactattccattaatgaaaaaaatcggttatcacaaaaactttgccggtgcggtagaagccagtgcatctgttggtgggcaaattctcccgccgatcatgggagcaagtgcattcattatggcggaaacgacaggcgtaagctacggaactattgcacttgcagccttacttcctgccttactttactatctcggcgtcattgcacaagtccactttcgtgctggtaaacaaaacctaaaaggcgtccctaaagatcaattgccaagggtaaaagcagtgatgaaagcacgtggtcatatgctattgccgatcttagcccttatcatctttttggcacaatccgtaccagtaggatatgctgcctcttatactattgtgcttaccattttagtcagtcaattgcgtcaagaaacccgtatgggcattaaagatgtaattgaggcattggctgacggggcaaaacagtcgctttccgttatgtcagcttgtgcgacggtaggaattgtgattggcgtgatgaaccttaccagttttggtacagtgattacctcttctatcgttacattaggtgcaggatcgctctttttaaccttatttttaacgatgattgcctccatgatccttggcatgggactaccttctattccagcatatatcattaccgccaccatggcagctccggcattggcaacctttgatgtcccggtattagtggcacatatgttcgtcttttattttggtattttcgctaatatcacaccaccggtcgctcttgctgcttttgctggtgcgggaattgcacaaggtgacccaatgaaaaccggctggcaatccttgcgtctagccctagcgggttttattgtaccgttcatattcgtttataatccgaatatgctgatgattgatgttaccaatgctgcggttattgccaaaactttccctctaccaagtgcattcgaaattattaatgttatcgtatcctctgttattggcgttttgggattatctgctgcggtagaggggtatctgaaaaatactataccaatatggcaacgtattattttagcaatcggttcgcttatgttgattattccggaatggagcacggatattatcggcattgctgttgttgtagtcatagcactacttaatgttcgcaaatgtgactaacaattgttctgtgcatacgataaatgacataactaaatgtctaattaacttttttagatttgaaccaatcattaccccttgattttgcatagcttcacaaccggttgtggcggtttgggtgttagaatgtaatgaaaaaggttatttcccttaacacccaaaatactcaaaccccaccgcactttgcaagtacagtggggttttttgttgtgtttcagcaagtttgacaaattaccactgataacctaccgacacggcaccggatactttgccttgggaattgctattaccttgcagtttcagcataaccttaccgttatcgctgatgcgagaataaccaatcgccaacgcactttcgccatcatgtcctgccgccgcaatcgcaaccatggacttacccggcatagagactgatgccaatgctgctgccgcattcgctccggcaataccggcacgcaatcggcgatcggcatgatgtatttgtgtacgtaacgcattattttgactgtccacatagtttttattgactgcaacaaatccacttgcatcaggtttgacatccggaattaaaatttccccacggttaccattgatgacgatattaccgttattgcctgataccatcaaccctgcatgggttgccatcaatgacggttcagcggctttgccttgtagcttaatgccatcgagggtgtaacttgctgattgaccggcatgatttcctttgcccgtaatacgggtaccctgtgcatttacaaaagtttcgctgtctggactgctcgcttgtaaaccgttgctgttcaacaccgattttttgccattgatttcacgtgtctcaaaagaagtcatgtttttcaactggtcggacagtttgacgactaagcccttgccgtctgtttccaccttgatattgccggcggcggtgaggttgctgttaaacgtatcaccttcacctttaattgctaaggtttcgctgagttgtttacgcacttcaacaccatcattgcccttaaacttcaagccggatttcgctaccgcctgcacgtcagcaatggtggctacgttggttaaatccgcttggctatcaggtttcactaagtcagcaactttttcataacccttgtagttggcttcatagtcagcattggcttttgttaattctgtctgagcctcggttaaagcagtttttgctttccctagatcttctttagctttttcaagctgtttcttgttttcctccaattgagtttgaagtttctttttatcctcaccctcaggcatggcactcatcgccatttctaaaccgctcacggctaaagttaaatcggttactttttgggctgtagttgaaagttctttcgctttatcgcctattgctttcactttttcctcaacagcttcggtgagtgcagtcgctttctcttgagccgcttttgctttaaccgggtcagtttcaggggcaggtagtcctaaaccactcgccacgttattcatcccgataggtgtggcagtcggttcggcacgaataatgactttatccgattccggtgtaacttcttgtccatcttgagaagtatattttttactttttgcatcatacttcgccccctctaaatctttaggatcatagaacttaccatcacgtcctttgacaactttggtatagtcatcgccctcttggatatagaagtcaaacggacgattgctgtctaagtcggatactttttcatccacatagtttttattcgccgcacttgaaccgtcagccgtggcatctaggtctttcaagcccatgattacgcctgtacccgatttaccgtcagtgcctttagcaaacgccagcgtagctcccttgccatcttgaccgtcctcaccgtcagccactttcaagctcacgacatctttaccagccttgtccttaatagcaacctcaccggcttttacctcggttgtgtgcttgccattgcttaaaacattcgcttccgccgtctgatcattgaccaaaacctgatcatcgctgaccacagacattgtcacgccctcagccgttgtcacaaccgctttttccttatcaggatctgtattatccgtgatgatttgcgatgtcgccgtttgtgtatgagcgttacctgcctgatctttcaacacaatttcattgccggtaatgttagtagtgttaccgctttcgccgttaaactcagcagatttcaaacctgtcaagtcctcagtcgtaccaatcgtcaccaccgctgtagtgttcgaggttttgcttggtgtactgcttgctgtgccggctgttgtcgtacttggagcagaacttgttgaagatgtactgcttgtaccacttcctccatctgtacctgcaccatttgacgaagtcgtacttgaagcgaacgtactatctgcccctacactgctatttgatacagtgtttgtcggtgcggttgtcggagttgtactgcttccgacagttgcacctgcaccttgtgcagccactcctgacgaaccagacgtacctaccgtagctgtaccatttccaccgccagcggtacctgcaccacttgcaagtgcagaactacccgcacttggctgtgtagtaccattttgagctaactctactttaatattcaagccagcgttaaatttcaaggtgtcgttgcgaccaatttgataagttgtaccatcactattcgccacattgaatttaaagctatctaacgcttgttcaaggtaggacttggtgattaagtcgttatcttccacccctttattaccatatgtttgcggtgcagacaaagtcactttgttaaatgtcggtgcgtctttaaagccgatttcgattttggcgttgcccttatcataagtgtattgcgtgattaagttgctaccgctgtaaccatcggttgatgttggatctaccgcacctgtccctgtcggcgtacccaaacgcacaatattaatgcttgagccgagataatgggtgccgttatttttacctgttgtaacatcaccaccgaactttaagccctcgtttaacttcgctcttgtttcgtcaatagcctctttcaatgtggttgggttcttctctttgaatgagccatccacattagacagatattcaaaaattagctcgttaaatttcgttttatccttatcaaccgcaacacccaacttactcgctaaatccgccagttgtttacctgtaacagcttcttttgaatccttatcaatttcaccgtctgcaaggtttgtgagttttgaatcattaaagctgatttcttttttagctttgtctaacgtgattttcgcccctttttcgtctgtaccgccccaaatactcgttatatctttaaggttgttcgcaaggttatgctggattgaaccattcttatctacaacgacttctatattgtcatttgtagctttcttaaagtccaagccgtccgttagtttgacggtttgcttatttgtgctattagatttatatgtcaattttaattcatcaacatattttttattgacggcatcatatttatcagttggatctgctacgaaaactatttttcttctgtttactgcattccctaccgatacagcattggatacgcctattgatctgtctcctaatactatcgcattttttatagtatcatctgtttctatgtgagaacctaataatatgttttcatttccatctactttgttgcccagtcctatagaaatatttttatatccttttatctcattatttgaacctattacatagcttgatgttgaatttaaacctattttattttcatcacctaatacaaacgagaaattacctttgacatcattttctttacctacagcgacagaacttgttcctaatacggttgaaccctgaccgatagagattgcaccgctattagacgcctcagagttataacccatggcaatagaaccctcatttcttgacacggcattatgaccgatagaaatagaaccctcgcctatcgcttgtgtttttgcggaatcagaaagtttaacggatttctccccagtgccttttaggtagtcgactagggctttggcttgtactaattcgcttgtgccttctgtttcctctttctcaagagcaatttcagcaataccgacattttcaccaaatgtagcttgatttttccctatattctctcctgttacttttaagaactcttttcctaaagtttcagtcgtagtatattttttcaattcattagcaacagcacttgatttaatagctctgtcatcgttttcatcaacggaatttgatttgttaagtttaagtgttattgttccagcatttttaggatctttaggatctgtatcattaggtgttacttctaccttaatgtctttttctgttttatctttattagattcttttcctacttttgtatcttcaccatttattgttaaagttgctcctaattgtaaggtagttgtcttactactatctgttcccttaaatgttatacctttattaactgctccaattagaccttcaattgcacctttgaatgttgtaattttgtctgatttatcagaaccttttattgcatcaaatgataaatctttgaatttaatatttttactgtcagtattatctacttcaagtcctaatctagatacagataattcgtgtaattgtttaccagttatagcttctgttgaactaccatcaattttaccatctgccaatcctgataattttatactgctattatctttagtaaatgttaatgagtttccgccaacttttagagtagctttatctgttccattttcttttttatcaaacactaaagcattgtctgtatcttttccaatagttgttagccctgttgcttgaactccatcatttgttgaatctttttcaagtgttacttttttatcattttcagtaattaactctatcttattatcttcaaatttcaatgaagccttaccatcttgtttattaatttcagtaagtccacttaatttagatccagttaatgttacaactgatggtgtatcacctgatgagaatttaatagatttatcacctttatttaaagtaatttttgttttgtcatcattttcaattgactcaataccttttaattgtttatttaatgatacagtaaatgttcctttatttttagtatcatcaatacttaaagcaacattaatattattttctcctttgatgattacttgtttatctgtatcactattttttctttcaaatactttactaggattagtacttccatcactaaatttaatacttgcatcatttaaagtagttattgagctattagttgtagttattgcaccatcaagagcttttaatgcatcacctactgttgtatatgactttgtaccactaccattagttaatgtataagtaggtcctgttggtgttccgtcagtacctatcttagatcctccacctaatgctgttacaaatttatctaattgcgatttattaatagcgtcattgtcatctattccgtttgctacatttgaaattttaactttatctaaagttttatttaaacttaaagaaactccaccaagttttatagttgtagtattttcactaaatgtaattccatcgttagtatcttttcctattgatgttattcctgttaaagtttctccaagctcaatttttaagccttctccatcttttgatacataaatgtttttagcttgattagtagttgtttcagttcctttaatttctataacattatttacttttttagtaaaatccgaagagtcatttccttttaatccaaatgtagttttgcttatttctgtatttatttttccatcagtttcaccttttgaatatacatctaatttacttctccattttgttatatcaccattagatatatttgaagcatctacttttgcataagttgttccagcttcagttttagttaaaatatcatctattttccctttagattctccatcaattttaactgttattttcttatctttaatctcaacattaataccatcttgcccttcaacttgtaatttatctgtttttaaattaatagttgcatcggctgtacttccatcttttgatagtataagggaagttgaaaatccttgcatatattcataaacagtttttcctgtaactgttcctttatcatctttttcaactttaccagttccaattaatgcgattttgtctttagtttctttatttaaatcaatagaaactccgcttccaattactgctttatctccaccttcaacttctattaatccattactaactagatcacctgtattaaatttatcagcttttccatctagcttgtcagtaacatattttttagtcgttaatacattgtctttacttgtatcttttacttcttcacttactgttacttctttaaagtttggattttcttttatacctattaatatatttttatttcctttttcataatgtgtcctaatattatcacttaaaaatttatctgttttctttgtttgtttatcttcaactgttatagtcccagcttttattatcaagctatctcctaaatagtgtgttcctttttcttcatcactatctccagctccaaaaataaaaccttcattaattttagcaatattatcatctatcgcttttttaaatgtttttgctgtagctggtgttgaagcagtaatagtttttcctattaattgcttaaattctgattgtttaaatcctttagttgtatctacttctgctcctaatacagttactcctaaatgtccaaatacatctattacactatataactgacttccatttattgcgtgtgttgagcttgcacttattgttcctggtgctacatgtgtaataagacgttcttttccagtatctcctatacttaaaactgatttatcatttccatgtccactaaaattaataaatttaatactatttgtatctgttgtatatgttgcttcagatttttctttttttgtcgcttctgacccttgccccaaggcaatggagttgccggcgtcggtttttactgttgcaccttgccctatcgctactgcaccgacggcacttgcttcggctttagcactatgaccaataatcaccgcactttttgcacccttgccggcgtttgattttgccccaataagcacactttcttttgcagtttcagctatcgcaccattaccaatcagaattaattctgtattcgcactttttgttcctttagtctcctcattggtaatatccaatgctttaatattgttccctaacgccacaatatccgtaccgtttttgattttgtttttattaccgatagacgctgtccaagcggcgttttcaattaaagtgccatctgctccgtttttacctttcacaaaaaccgcaccgatagcgatagaactttttgattctactaattttgttccgctaccgatcacaacaaccgcaccatttgtatccttaaagttttgcgtaactgtattattagaccctagcacaaatgaattttttacatcaatgctaacatctctacctatcacaaccgcattttctgctgttgctttcgtacccataccaatagcgatagcaccgtcagctgttgctccatcgttattgtaattgttttttgactctggggttgtcggggctttaaccgataaaaagtgtaattttgacgcttctaattgcttaaagtttacaacgtcattttcagctactccatcagcaacgcctgaaattttaaccttatcgtcactagttttacttaaacttaacacagccccgccagctttaatttttgtgccaccattgaatgtgatttgattattttcatctttaccaatagaagttatacctttcaacgtactatttagtgagatttccaactcttttttcgtaccatttttagcagttgtggtaatgtttttgtgtgaattttcttctttacccttaatatttaatgcatcttttacagcatattctccactatcagcagttaccttaaaactagtggctacatttttaaatttatcatccacatattttttattaacagcctcattatctgttttaggagcatttgtaatagttacttttttaaagcttggactatccgtcattccaatcttaaatattgctttctcattacttgacttatcaagttgtacctttaagttttgatccttatgagtatttccaatatctccagcttttatctccaatgtcgaccctaaatagtatttactagtaccattgttattagttgttccatcactaaacttatacccttgatttatagccttaattgtttcatctaatgcgtctttaaaattatcaggaacaccttttttacttgtcggagttgagatatattctacagccgtaaatgatgatttcttaaactgcttattatcaacttctacccctatcacatccttcgccaaatcagaaaacacctttgttacagcatataattgacttccgttaatagcgtctgttgaattctcactcacatctcccgctgctacatttttaataatacgttcttggtttgtatctcctacgctgaaaatggtttttttactttcttctttattatcaggacttactccgcctttgaaagtaaattcaacaccatttatttcggctttgtttttagcctcctgtttagctgttaccttagatccttttcctattgctaccgaatcttctgctacttctgcaactgacgctttatatcctatcgcaattgagtcttttccttttgccaggcttcctttgtagttagattcttctatttcttgctctgataaattagcgacctgatctttttttgccatatctgtctcaacagcttgtgtaatttcctttaattttgttaataatttattaccatcaccacctttttcttttcctaagtcctcaacaatttttttaatagtacttgcttttgttgctatttgggaattacttttttctaatgcttctaattccttcttaactttatctaatgcttcctgtttaaacgtttccttgccatttacttttctatttaataattttgcatattcaccggataatttaacataacgttcataattttgttttgcttcttgaccttgtgctatttttgcactatcgccacttttctgctccacaccaaaataaggcgttaaattattttgtttattatttaagtctattctggtttctaaggcttttaattgtgcaacgttcacggcgtccgtatcttgtgaaccggcagcgacatttaccattcttctctcgtatccgttatatccgacagaaataacccctacattcgctgaagttgggataataattgctccctcgggtgtatatggatcggactttgaatgttcataatccgtttttgatttataacccagtgccactgaattttctaaagtagcggttgcttcattccctaatgctattgaagatttttcaagggctctcgtaaaacttcctaacgcaaatgcattagcctcttttgcaaaggcaaatcttccgattgcaacggtactgtcttctttggcgtaagcatatcttccgattgataatgcgttgtctccaagagcaacagtatacgaccctattgcgattgccccttggttatgtttaccttgattgtcttttgattgctcagctttttcttctcccgttcctctttgttttgtcgttttaggtttgattgaagttctgttgttttggatatcttttgtgtttcctaattcataaaatttatcgaaagaatatttacctctatattggtctctatttttgttatcagtaaatgttaatttactactaccttcatctaatccttctccggtaaaattttcatccatcgcgatatttgccaatgcataattacccatcgccaatgaaccgctaccccctgagtatgagtccgatccgtacaccatagaacccgaatttactgcctgtacattcgttcctacccctacagatctatcggcatagacataagaattattcccgaaaactaatgaatttctaccaaaagctatcgtatttgttcctatcgcggctgaatagtcttgataggcaatcgcgtacgttccaagtgcggtcgaataatctccatatgcaacacttcttccccctattgctattgagttattacccctagcccatgtatgggtttttttgtttttattagtgtcggctaaatattttttatatgcttcttctagatatccattatatttttccatccttttataatcttccatctgttcaatgtttgccggcttttcaattggatttaagtttccattacttaatttttcataatattgatcgccaattaaaacgtaataatcactattattatttttggattttcttatataatatttccctttccaaccaatagtaaatccatcttcactttttaaattcccatcatcatcaacatatttatttttattagttattgcatccataacatcagtatttttaaataaactactataatcaacagctgcatattcacctgtatagttaaaattagtcgcattatttagaaatatattaaatatttctttaggaagtggtttagcattctcaccggaaatattatccgaccctatagctatactgttagaaccccgagcaacagtatcattccctaacgacacagattcattaccataagaaaaggctctatatcccactgccgttccttggtggctgtcagttatattcgttgtagtaaggtttttacctacaatagcacggtaacctatagcagttgcgtcattacctccacctactgcacgcgatcctataactaccgtttttttgaaatctttattctttaaagatgtatttgcacccgttttgttttcactatcggctaataaaacaacttcattcgtgttattaacgttacttctttcataccaaacagacgaaggcttattatcaccacttcgttcgttactaggattaacgtcaatccacacattcaccccatacgccacactcgacaacaactcactcatcaataatgccaatggcagaatcttaaacatgcctaaaaacacaccgcacttcggctgacgccccgacgctccctcaacacggctcgccacctgacggttattcgctaattcagacacaactttcgtttgacccgttgttacatcgtatttggttttgaagattttgttcatattctttactcgctttaaaaattatctgttaattacttattaagtggttattgatcgaatctattattgtttatttattatctcttactgattatttattaaactttagagagataggttataaacctaaataataggcgatgccttgctttttaagacaaagcagaaaaaggcgaataatactttcgccaaaagattgaggttgaaataggtgatttttaagatattgtttgaacatgtccaacctctcaaaattaacttgaaaggttgattttaggcaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcattttttccgttctatttttttgttaagtaaaagtaaaatttgtcgtattttatcttgtatttatttgtaagaaaagcgtaaattaattattttaatgtcggggcggattatatccgctctttaatgttttgtttaatgtgtttggttttctgttcgggttttgacttgcacctcaaataaaattcggagaaaatatcggcttttagtcagtataacaaacgatcatgtcatattctcaacaagtaaataaacgtcgcacttttgcgattatttctcaccccgatgcggggaaaacaacgattacggaaaaagttttactctatggaaacgctattcagaaagccggttcggtaaaaggcaaaggttctcaggcacatgctaaatccgactggatggaaatggaaaaacagcggggaatttctattactacgtcggtgatgcaatttccttatcatgactgcttggtcaacttgcttgatacaccggggcatgaggatttttcggaagatacttaccgcactttaactgcagttgacagttgcttgatggtgattgacagtgcaaaaggggttgaagaacgtacgattaaattaatggatgttactcgtttgcgggatacgccgattttaacgtttatgaataagttggatcgtgatattcgagatccgatggaattgcttgatgaagtggaaagtgtgctgaaaatccgttgtgctcctattacttggcctattggttgcggtaaattgttcaaaggtgtttatcatttgtataaagacgaaacttatttatatcaaagcggtcaaggacatactattcaggatgtgcgtattgttaaagggttaaataatgctgacttggatagggcagtgggcgaagatcttgctcggcaattacgtgatgaattggaattggtcaagggggcgtcgaatgaatttgatcacgatttatttattcgtggggaattaacgcctgtttttttcgggacggctttaggcaatttcggtgtggatcattttcttgatggcttgactcaatgggcccccgctccgcaagctcgtcaggcggattgtcgtttagttgagagtgcggaagaaaaattaacagggtttgtgtttaaaattcaagctaatatggatccgaaacatcgtgatcgggtcgcttttatgcgaattgtttcgggtaaatatgaaaaaggtatgaaactgaaacaggtgcgtttggggaaagaggttgtgctttccgatgcactgacttttatggcgggtgatcgttctcatgcggaagaagcctatgccggcgatattatcggcttacataatcatggcactattcaaattggtgatacctttacgcaaggtgaagatctgaaatttactggtatccctaattttgcaccggagttatttcgccgtattcgtttgaaagatccgttgaaacaaaaacaactgctcaaaggcttggtgcaactttcagaagaaggtgcggttcaggttttccgtccgttaaccaataatgatttaattgtgggggcggttggtgtactccagtttgatgttgtcgtttctcgtttaaaatctgagtataacgttgaggcggtttatgaaaccgttaatgtggcaacagctcgctgggtagaatgttcagaggcgaaaaaacttgaagagtttaaacgtaaaaatgaacagaatttagcgttagacgggggagatagtcttacttatattgctccaacgatggtaaatcttaatcttactcaggaacgttatcccgatattcagttttttaaaacaagggaacattagtctttgatatgatagacaaaagagcggagatatttccgctcttttttgttgtttaaatagagaaggttactcggtttaaatgcgatttaaagcgttgtgcctattttcaactcgcattaatactcttgaacttcttcgtgttttcctaccgcacttttgatggttaattgcacttcagtagaaataattctatcgagaatatcgctaatgtcatttaatttctccgttatagcgacgccatttttatcaaaatatccgttggatcttaagctaccgataaaagcggaaaagacggctttatcgaaaaattccggtgcattaatgccatgcaatacagataaccgctgtgcaatagattggctttctttctctaaagtcgctttggcaatattcggggtatcttgcaagatactgacggtaatataataacgttgtaaaatttctcgaactcccgccatccataactgtaaaactcttacacgttctttattgattgaaagaagattttctgcacacagaattaatttttgacgtgtaaattcctcaataattttttcaacatattcatctaattcatcttgtgaaaagtgtaaaaataattcctcttttaagaaagggtaaatttttcgagctgcatttgataccaactctttttgtattgcaccatgatgaaaaatgatgcttgcaattaaagaaggtaaaacaaaaacatgttggatattattacgataataggtcatcaatactgctgctgaacgttctaaacgcaacatttcaccaaaattatctttttctacgataagtccgactcgttctaagtttaatacatgagtgagcatttcttccggtgtatcagtcggtacaataatatcgttggaataaggggcgtgttgtaaaaagcgttgataacttttcagttgttccaacagttgttcacgagataaagcacgttggcgagaagacaaaagtgcggtgcccgttaagttcattgcattaattgccgctgctttgttgatattgatcatgacttgatttgaaatggcattaactgcagggttaaaccattgagaatgatcttccagctggctatctttccattcaggaaaatgttgatttaagtaattacttaatgtgataggttcggcaaaatttacataaccttgccctaaattgcgtaatttgcggataacacgcaagaccaaaccggcgttttctttctcttttgccgccccccgcaattcttttgcgtaagtatctacctctaatacatgctcatagcctacataaaccggcacaacggaaattggtctgatttggttttgttgtaaggcttgtacagtcatagacatcatacctgttttcggggcaagtaaacgtccagttcttgatcgaccgccttcaataaagaattccacagagtagccacggtgaaataattctgctaaatattcacggaaaatggttgaatataatcgatttcctttaaaggttcggcgaataaagaatgcacctcctcgacggaacatcattcccaccggccaaaaattgaggttaatacctgcggcaatatgtggaggcactaacccttgatgatatagcacataggacaataacaaataatcaatatgactgcgatgacaaggaatatatacaatttcatgtccttctaacgctaatttacgtacacgttccgcattttggacatcaattccttgatataatttattccataaccagcctaaaaaacgatctgcaacacgcaatccctcgtagttcacattggcggcaatctcatccaatatcttatatgcttctttacgtgctttttctttgctgattctcttacttttcgcttcatctgcaatggcattgagaattgtcggtgattgtaataatttattaaacattgcttggcgattaggtaagcgaggacctgtagcggacattctttgtttggcaaaatggatttttgccactcgagcgagttttaaagcaatacttgcatctgttccatattcatcagccatatagcgtaaagaaaccgcttgtgaaaaacgcacaaaagtatcacgcccaaaccaaatagccacagctgttttttggatactatttaataaacgaagttttggtaagccaacctgcttttcatgacccggagaacgcccccaaagtacggaaacaggcactaactgtacatttaaatcaggtaaagagcggtgtaattcaaggtatttttcaactatctgaatagtcgctgacttagcacctttcgatttaaaaaaacgtctaccttcgtctaaaaatacataacgaggtaaacattgcccccccaattcattctcttctaagggatcaggcaatcctacgcttaagcaatttttacggataataattaaatctgtttgtgaagtgtaaggtaataaataaatgatcggttggctaatatctaatgataattcttcgataggttgttgcggtatagggttatttttaactaaaaaagagagagggacggacaaaagattacgataaaaattaagaatacttgacataacaatttccattaacttattaggttgattggctaatgaatactattctaacaaaaaaaatatttttttattaataaattaatttattgaaactaaagattgatgtaattttatttctgtatataatatcatatattctgtatataaaaacaggggttagtatgagttcaataaaatcattaacgacacgacaacaggaagttttcgatctaataaaacgtcatatcgaaagtacaggaatgcctccaactcgagtggaaatatctaaagaattgggatttcgctctccaaatgcggctgaagaacatttaaaggccttggcccgtaaaggtgtaattgaaattgtatctggtgtatctcgtgggatcaggctattaacggatatagaagaaccggaaaatgaaggacttccgctgattgggcgagttgccgccggtgaaccaattttggcggaacaacatattgaagcaacttatcaagtcgatgctaatatgtttaaaccgcaagccgactttttattgaaggtttatgggcagtctatgaaagatattggtattttagatggtgatttgttggctgttcatagtacaaaagacattagaaatggacaaatcgttgttgctcgaattgaagatgaagtaacagtaaaacgctttgagcgtaaaggttcggttgtttatttacatgcggaaaatgaggaatttgagccaattgtagtagatctaactcagcaaccttactttgaaattgaaggtattgccgttggcattattcgcaataatgcttggatgtaaacatgacatcatgcagtaaatttgttatttaaaaacgagtagcggaacaaaaataagccaacaactatttgttggcttatttttaactatctagcataaatctcagcttcggcaaaaaaataggcaatttcacgttgtgcattctctaaactatccgagccatgaacggaattttgggtttgattaatagcaaattcataacgtaatgtgccattttctgctatttccggattagttgttcccataaaagtgcggtagtcttttaccgcattttctttttgtaacaccaaaacaactataggggcagatgtcatgtatttaaccaattcagtaaaaaacgctttattgcgatgttctgcataaaaaccttccgcctgttcttgatttaaatgcaacatcttcatagcaatgatttgaaatcctttgtcctctaaacgagaaatgatgttacctattaaatttcgttcaactgcatcgggctttataatcgctaaagtttgttctaatgtcataggtctctccattattcagctttatttaataaaaaattcgccaaagtttgtacaccgattcccgttgcacctgttgcccataagtcacttgctgatttacgataagttgccgaacaatcaatatgtaaccaattttcttgataattttctacaaaataagataagaatgccattgccgtacttgcaccggcacccattggaacagtcccaatattggcaatatctgcaaaggatgaactaatttggtgacgatgtaattcgtcaaaaggcaatcgccaaaacggttcttttgtactctttgcacaatcgaaaaactgttgagtgagttcgttatccattgaaagtatcgcatgataatcattaccaaccgctacttttgctgcaccggttaaggttgcacaatcaagaataaatttaggcttcgctaaatccgcatcaattaagccatcggcaagtaccaaacgcccttcggcatcagtattaagaatttccgcactgataccattgcggtagtgaataatatcacctaattttaaagcgttgtggctcaccatattttcagcacaacataaaaatagtttaactcgtttgttaagccctccggctattgccatacctaatgcacccgttaatagtgcggcaccgcccatatctgttcgcattgtactcatgctatcacttggtttaatgctgtaaccaccactgtcaaaagtaattcctttaccgactaaacaagccagtaccggtgcattttcatttccggtaggattaaaatccagctgtaacatagccggtaaattttctgagcctttacccacttgccaaatcccttgatagtttttttcagcaagttcttgtccggaaataatctgaaaagataccgcactttcgtcagcataaagacttgcttgttcggtgataaattgtgccgcacgctttgcaagttcaataggggtgataattgaagaggggagattaataatttcacgcacaaaatcgccacattgaattcttgccagcaattcagcttgtggctcgtcctctaaatgaggaaattcaatagcataatcttgtttagcggtataaaagccttgatagaatgcccaacaattttctaaatcccattctgatccaataagttcaacttcttttattccttgggtgcgtaattttcgagcggctttttgaattaaagaaatgtcttggttacgtgtcggatgatgaatgatggcttgatcgtgagtaaaactgattaaagctttttttccccattgttcttttgctggtgaaatttctattttaatttgcatactttatccttaaatttacttgataaaaaaactgatatagatggcactataccagtttttattgaggtaacaagaatgaatagggagaataatcagaaataaagtctaattagcgtaaaaaagcaggaatgtttttttcatactctgcgattttatcttcatgttgcaaagtcaatcctatattgtccaatccatttaataagcaatgacgacgaaattcatctaattcaaaatgataaattttatttcccgttgtgacggttaaattttctaaatttacatgaatttcacaacctttatttttccatacccattgaaaaatttcttccacttcttcttcattcaaacgaatgggcaacatatgattattcaggctattattatagaaaatatcagcaaaactaggtgcgatcatgaccttaaatccataatccgccaacgcccaaggtgcatgttctctagatgacccgcaccctaaatttttgcgtgcaagtaaaatcgttgcaccttgatactcgggaaagttcagcacaaatttaggattaggtactgtaccttcctcatcaagataacgccattcgtggaataagtgttttccaaaacccactctggtaatagcttgtaaaaactgttttgggataatcgcatcagtatccacatttgcggcatcaagaggaaccactaaacctgaatgttgtttaataccagccataaatcttccttaatttaattccatataacgaatatcaacaaatttaccgaagacagccgctgccgctgccattgccggacttacaagatgggttcgtccgttacggccttgtcgcccttcaaaattacgattactggtcgaagcacaacgctcccattcaccaagtcgatcatcattcatacccaaacacatagaacaaccgggattacgccattcagcacctgccgcaataaaaattttatctagcccttctttttctgcttgttctttgaccaatcctgagccgggaacaacaagtactcgttttacgttatctgcttttttgcgacctttcattactgtagctgccgcacgcaaatcttcaatgcgggaattggtgcaagatccgataaatacttgatcaacggaaatatcttttaaatcagtttccggagataagccaatataagctaaggctttttctgcggaggctttggtgacgggatcttgcatttctgccggattaggtactttctgatcaataccgataacctgacctggattggttccccatgttacttgtggagcaatgtcttttgcgtctaatatcaccacagtatcaaactctgcaccttcatcggtttttaaggttttccaatattctaccgcactttcccagtcttttccttttggtgcataaggacgatctttcaaataagcgaatgtggtttcatcaggtgcaatcagtccggctttcgctcccatttcaattgccatattgcaaactgtcattcgtccttccattgacaatgcacgaatagcttcaccacaaaattcaacaacatgaccggttccccctgccattgtggttttaccgataatggcaagaataatatctttggcagtaatgccttttgcgacttcgccacgtacttcaattttcatacttttggctctggcttgttttagtgtttgcgttgcaagaacatgttccacttccgatgtaccgataccaaaagctaatgcaccgaaagccccatgagttgccgtatgggaatcaccgcaaacaatcgtcatgcccggtaaggttaatccttgttccggtcccataacatgtacaattccttgctgtttactgttcatatcaaacaaagaaattcctgttgctttacaatttttatctagctctaaaacctgaattttcgcttgtcctgttaatttgtttacgtcacgcacttgagtagaaatactatgatccattgtgccgaaagttttattcacttgacgaacctgacgacctgctacacgcaatccatcaaaggcttgaggtgaagtgacttcatgaattaaatgacgattaatgtacaaaatcggcacttctcccggtgcttcatgtacaatatgagaatcaaataatttttggtagagtgtttttttcatatttattccgttaagtttttttcactaatcaggtaagtgcggtagaaaacgagaaattttggctaaatttaccgcactttatttttcattcactattgcttaaattgcgtttgcaattaagtttcccatttcagctgtggaaattggcggatgttcatctgctaaatctgcggttcgataaccttgagaaagaacctgtttcactgcgttttctattgaatccgcctcttcatttaagttaaagctataacgtagcatcatggcagcagatagaatttgagcgattgggttggcaatgcctttacctgcaatatccggagcagaaccacctgccggttcgtaaagcccaaaaccatgttcatttagactggcagagggtagcatacccattgagccggtaattattgccgcctcatcagaaataatatcgccaaaaatattagagcaaagtaagacatcgaaaaattcaggttgtttgatcaattgcattgtcgcattatcaatataaatatgatccaatgttacgtcaggatagttcttggcaacctcattgaccgtttcacgccataataccgagctgattaatacattggctttatcaacagatgttacatgtttacgccgtttcatcgctgtttcaaaagcaactttagctatacgttcaatttcatatttgtaataaacttctgtatcaaaggcacgagtttgcattccctctccatctcgtcctttaggttgaccgaaataaatgccgccggttaattcacgaacagtcatcatatcaaatcctttggcggcaatatccgctcgcaatggacaaaatttttctaaaccttggtaaagtatggcaggacgtaaattacaaaacaatttgaaatgtttacgcaatggtagtagtgcacctcgttcaggctgctgattagggggtaaatgttcccattttggtccgcctaccgagccgaataaaattgcatcactttcttcacagccatttaatgtagaagcgggtaaaggcgtaccatgattatcgatggctattcctcccacatcaaaagtgcggtaatttaatttgaaattatattttttttgcactgcatccaatacttttatagcttccgccataatttcaggaccgataccatccccacttaatactgcaatagtataacttttcatgatttttcctctttacatcaactttactgtgaaattttatgcgattttaaatctgccactttattggcacgataaatggcattgattgcatgaattaaggcacgagccgaagattctacaatatccgttgccaatccgacaccatgaaaacgtcgccctttatgttcgacaacaatatccacttgtcctaaggcttctgctccctcaccttttgcagtcaggttataatgcaacatagttatatccatatctgtaattgctaaaatagcgttataaacggcatcaacgggaccatttcccccatttgaaacttggctaatttttttaccgtccagttcaacttgcacaaaggcagaagccggtaaattactgattgtttgagaagtaataacatccaaacttagccgatcttcatcaccctgttgcatatcaataaatgccaatgcttccaaatcataatcaaatacttgcccttttttatcggctaattttaaaaatgcggcgtataatttatccaaatcataatcgttttgttgataacccattgcgtccatatggctttttactgcagcacgtcctgaacgagcggttaaattcaatttttcttttttcaatccgatggtttccggtgacataatttcgtaagtatttttatttttaaccataccgtcttgatgaatacctgaagaatgtgcaaaagcatttgatccgacaatagctttattcggctgaattggcatattacacaactggctaaccatctgactgacacgatgaatttcttgtgtattaattcgtgtatctaagcccttaaatatatcttgacgtgttttaattgccatgactacttcttccaatgcagtatttcctgcacgctccccaatgccattaatggtacattcaatttgtcttgcaccgttttgtactgcggtcaaagaatttgcagtcgccatgcctaaatcattatggcaatgcaccgaaattactgctttatcgatattcggcactctgttcatcacttgatcgatgatattaccgtattcggttggtaaacaaaaacctaccgtatccggaatattgactgttgttgcacccgctttaattgctgcctcaacgatacgacaaatgttgtcaacacctgttcgaccggcatcttcgcaggaaaattccacatcatcggtataacgtctggcacgttttactgcttgtattgccatttccacgacatcatcaaaagtgcggcgtaatttagcttcgacatgcaaagcggaagtggcaataaacgtatgaatacggaacgcttcagctacttttaatgcgtcagccgcaatatcaatgtctttatccactgcacgggataaggcacaaacacgactgttttttatatgacgagcaatggtttgaacggattcaaaatcccctgctgatgatactggaaaccccacttccattacatcaacacctaaacgttccaacgccaatgcaatttgtaatttttcttttactgttaaactggcttttaatgcctgttcaccatcacgcaatgttgtatcaaaaataataatgttgttttgcataactctttccttcttattttgtatgttgccatctgcaaagtgcggtgcttttttattgattttagatacaaaaaaacccgcattttacttgtgcgggtcaactgacatgtttaactatatttctttgttccacaatttatccgcacaagaaatgtgatagtcgtaaattgagtaacagagaaagaatgtcaaacataaaatatcctaaaaataaaccaagatgggtttatattacgagtttaaaataatgtgtcaaatgattttttagagttttataccaaataaaaggttattcaaaacataaggttaatacataaaactaacttttaataatttaatagtgttaaaatccacgtcattaaaaaattttaattttttctaccgcactttagctctttcatagtaatgaacgtaaatttgtgtttttttgggggttctaaaaaataacttatcggcgttttttgagttgattttgttttaaatcaaataatcctatcatatacaactaaagagttatgcttttaacgtttcattttttacaccatgagtatagcttatgatagaatgcgtctccgaaaatgtttaaataacttcttatgcaaaataatcatctacaactggaacaacttgcctgtcagcgtggcgataagattttgtttactgacttaaatttagatgctaagtcgggagattttgtgcaaattgaaggacataatggcataggaaaaaccagtcttttacgaattattgtgggacttagtttccctgctaaaggtaaagtgcgatggaataagatcgaaattaataaaaatcgtgaagaataccagcacaatttactctatttggggcatcttgctggaattaagcctgaattaagtgcttgggaaaatttacagttctatcaaaaaattggtaattgtcgacaaagcgaggagttactttgggatattctacagaaagtggggttattgggtcgagaagatttacctgcaggtcaactttctgcaggacaacaaaaacgtattgcattagcaagattgtggttatcaaatgcggcattgtggattttagatgagccttttacagctattgataaacaaggtgtcaacgttttaactcagttgtttgaacaacatgtggaaaatggcggtattgtgattttaaccagtcatcaagagattccgagcaataagttgcaaaaagtgcggttagatcaatacaagttttttgatcaagggaatatggcatgatttttgtacaaattatcaaaagagagttaaaaattgcttgtcgaaagcaagctgagatcttaaatcctttatggttttttttgattattttaaccttgtttcctttggttattggtccggatcctaagctattagctaaaatagcccccggaatagcttgggttgccgctttgctatcggcattactttcatttgagcgtttatttcgtgatgattttgtggacggttctcttgagcaattgatgttgacagcacaacctttagcgatgaccgccttggcaaaagtcattgcacattggcttttaaccgggttaccgttaattttactttcgcccattgccggactattactttcattggagttgcatatttggtgggcattagttttaacattgttgttaggaacgccaaccttgagttgtttgggagccattggtgtggcacttacggtagggttgcgtaaggggggcgttttgctgagtttattagtcttacctctatttataccggtattaattttttctgccgctgttttagatgctgcaacattaaatttatcttataacgggcaactcgcaattctgggagctatttttgtttcagtggcaacactttcacctttcgccatttcaattgcgttaagagtgagcttagaccagtaattaacttagtgaagatttgttttttaaataacatagtaaggacaacatgatgtggaaatggttacatccttatgcaaaatcggaaacacaatatcacttatgtggtaagtttgttcctttgtttgcaacagtatctatacttttattaataaccggcgtaatttgggggcttgcttttgcaccggctgattatcagcaaggtaacagtttccgtattatttatattcatgttccggcggcaattttttctatgggaatttatgtgtctatggcaattgccggagtgattggtttagtttggcaaattcgccaagcgtatttgagtattctcgctatggcacccatcggtattgtgtttacttttttgacattggtcactggagcaatttggggtaaaccgacttggggaacttggtgggtgtgggatgctcgtttaacttcttccttgattttattctttttatatttaggcgttatcgcactttactctgcttttcaagatcgtttaatcggtatgaaagcagcagcaattctttctattgtgggggtagtcaatattccggttattcatttttctgttcagtggtggaataccttacatcaaggggcaagcattacaaaatttgaaaaaccttccattgcaacacctatgttaattccgcttattctctgtattttcggttttatggcattaacaatgtggtttactttaatgaattatcgaacccaactgttaaaagatgagagcaaacgcccttgggttaaagcattagtaaaataggagtttattatgttttttcaaagttggagtgattttttttatatgggcggttatgggctttatgtctggctatcttatgggatttctttccttgctattataggattaggcttgcaaaatatttatcttcgcaaagccctatttaaagaaattcaacgtgaacaattgcgttcagtgcgtcaaaaaaatacgcaagctgaaaacaatggagaaaacctatgaacccaagacgtaaatcaagattatcggtagtactgtttattttactgggcatatccgttgcctctgctttggtgttgtatgcgttgcgtcaaaatattgatttgttttatacgccaacagaagttgtgaatggaaaaaataacgaaagccataccaagcctagtattgggcaacgcattagaattggcggaatggttgtggaaggaacggtagaacgtgatcctaaaagtttaaaagtcagatttgacttaaatgatattggaccttcagtaacggttatttatgaaggtattttgcctgatttatttcgtgaaggacagggcattgttgctcaaggtgtacttattgagccaactgtactgaatgcaacggaagttttggcaaagcatgatgaaaattatgttccgccggaattagaagcacaaatgcagaaaattcataagcctatgggcatatcggatctcaagaatgaaagtgatcgtgatcgtcaagaaaaacaatttaaagaaggtaaccaatgatcgctgaattaggcaattatgctctggctttaagtttagctatttctgttttattatctatttttccattatggggagcggaaaaaggcaatgtacagatgatggctttagctcgcccaatgacctatggtttatttgttagcttaactgtttcttttgttgcacttttctatttatttctgacaaatgatttttcagtacaatatgtggtgaacaattcaaataccaacttacctttgcaatatcgtctatccgctgtttggggctcccacgaaggttctttattactttggatttggctattgactctttggagtgcggctgtggcttttttgagtaaacaattaccccaagaagctgtggctcgtgtcttggcaattatgggtattattacgattggtttcttactatttgtgatgtttacttctaacccttttgaccgcactttccctgattttcctgttgagggaagagaattaaatccattattacaagatattggtctgatttttcatccgcctttactttacatgggctatgtgggtttttccgttgcttttgcttttgctattgcatcattgatgacgggaaaactggataccgcatgggcaagatggtcccgaccttggacaatggctgcttgggtatttctaacattggggattgtgctgggatcttggtgggcatattacgaacttggctggggcggttggtggttctgggatcctgtagaaaacgcctctttaatgccttggcttgccggtactgcattgcttcattctcttgcggtaacggaaaaacgtggttcatttaaagcatggacagtattgctggcaatcttggctttttcactgtgtttattaggtacttttttggttcgttctggtattttggtttcggtgcatgcttttgcctctgacccaactagaggtttatatattttagcttatttaattgtagttattggcggttcgctagcgttatacgcttataaaggcaatcttattcgcacaagaaacaatgctgaacgttattctcgagaaactatgttgttaatcaataatattttattaatgaccgcacttagtgtggtgttcttgggtactctcctgcctttagtacacaaacaattagggttgggaactatttctatcggctctccattttttgatcaaatgtttttattgatcatgatccctttatcacttttattgggtgtcggacctttagtaaagtggcgtcgagaccaattctgtgctattcgtcttccggttatcatcagtttagtcattatgcttattaccggatttgttttaccttattttttacaagatcgtattacagtgagtgccgttcttggtgtcatgatggcaatgtttattcttcttctagcactctatgaattgcagcaaagagcaacgcataagcatagcttttggattggcataacaaaattgtctcgttctcattggggaatggttttagcacatttaggggttgcgatgacgatatggggaattgcttttagccaaaattacagtattgaaagagacgttcgaatgaatgtgggggatacagtaaaaattgcagattatgaatttactttccaaggtatatccgatgtcaatggtgtcaattacttaggcggaaaggcacaaattgacatcagtcgaaacggtaagtttgaaaccacgttgtttgctgaaaaacgtttctatacagtgagtaaaatgacaatgactgaagcggctattgattgggggttatctcgagatctatatgttgcactgggcgaaagtttaaatgatggttcatgggctttacgcttgtattataaaccttttattcgttggatttggctgggaggtatatttatggcattcggcggattactctgtatatttgaccgacgttatcgttttggaaaacttctaaaacaaggataagttatgaataaaaaactttatataccattaattttattcctcggactagcctttgctttttttgtgcaactgcaacgtaatgcacaaagcgataatccaaaagcattggaaagtgccttaataggtaagtcggtgccaaataaactgctaactgatttactgacagataagcaatatgacaatcgtctattcaaacagggtaaacctttgctcgtcaacgtttgggcaacttggtgtccaacttgttatgcggaacatcaatttctcaatgaacttcataaacaaggtattaacattattggcattaattataaagataaaacggataaagccataaaatggatcaaaaagttaggtaacccttatcaagtaattgtaaaagatgaaaaaggatcttttgggctggatctcggtgtttatggtactccggaaacgtttatcgtggatggaaacgggattattcattaccgccataccggtgatataaatgaacgtatctggaaagaaaaaatacagccaatttatcaacaagtaagtgagaaaaaatgatgacaaaattacgttattttctgaccgcactttttctcagtttttcagcacaagctgcgattgatgcacttaattttacctctatgcaacaagaaaaagattatcacagcttgactcaagaactgcgttgtcctcaatgtcaaaataacaacattgctgattccaatgcttcgatcgctgtagatatgcgggcaaaagtgtatgaacttttacaaaaaggtcaaaataagcaacaaattatcgattatatggttgaacgatatggaaattttgtgacttataatccgccggtaacaggttcaacaatcattttatggattgctcctttggctttgatgattcttggtgttgttattgtgctacgccgtaaatctggttcatccagcaaaagtgcggtagaagctcagccaaatttaactcaagaacaacaaaagcgtttagaagaattattaaaagaacgggaataaaaaatgattttctgggtaatttgccttttattaacattagctattgcatttatttgtttttatcctctgcttagaaacaagacagaaaaatcaaccaatttaaaacgagatgaattaaataaggccttttatttcaataggttgaaagaaattgaggaagacgaacaatacggtttattagaaaatagtcaagagtttaaaacagaattacaacaaacgttgttggaagatattcctgaaaaaatggctgttgagaagagcaataagcaatacggacaaatttggtttatttccggttttttgactttagcgattattgctcctttaacttatatgagtgtaggttcttggcaatctgagataatgttagaaaaaacttacgaaaaattaccgcacttttatgcaagagtaaaagaggaagcaaacaaaccgctaaatgaaaatgagctacaacaatttgctgttgcactgcggttaaaattacaaaaagaacccaataatgcggctgattggtggacgctaggacaagtggcaatgaatctggaaaaagcacaacttgcttttgatagtttttctcaagccaataaattagcaccgcagaatattgaatataagctatcacttgctcgaattttgatgttttcacaagatcaaattgatcgtcaaagagggatgaatttattaaaagaagtgttgcgtattgatcatactaatatgcaagccttaagtttgcttgctttccagtattttgagtcggaagattatcaaagagccgctgtaacttggacaatgatgcttcggttcatgccgaaaaatgatccaagagttcctttaattgaaaaaagtattcgtacagcacgtgatgctatcaaagaagatagcaaataaaaccggttatatatgaaaaatttaaagtattttgcacaaaaatatgtggattgggttattcgcttgggaagaattagattttccctattaggtgtttgtattttggcagtggttgctttgcttacacaaatagtggtgagtttaatttttatgggaactatctattggcaagatgtagctcgttctattatctttggtttgttttcagctccttttgttttatatttttttacgttattggtagagaaattggaaaaatcacgccttgatttagcgaagttagtggataatttacgcaatgaggtatcagagcgtattcttgctgaaagaaagttatcggttgcgttgagtgagattgaaaaaaccagtcaagataagaccgcacttatgacaacaatcagtcatgaattgcgtacccctttgaatggcattattggcttaagccagattttgcttgatgacaaattaacagagcaacaacgtaattatcttaaaacgattaacgtgagtgctatttctttgacgcatatttttagtgatattattgatctcgaaaaaattgatgccaatcgtatagaattacattatcaaccgactaatttgtgcagctttttaaatgatattaccaattttgctacattaatggcggcacagcgtaaattaaagtttgaattggtgtgcgataaagatttacctgattggctgatgttggatagcgcaagattaagccagatattatggaatttaattaataatgcagtgaaatttacacctgccggaaaaataaaactgaaggtttctcgcttgacggatgatactttttcttttgcgttatctgataccggtgttgggatagcaaaaggggagttggataaaatttttactatgtattatcaagtacaagaaaccgatcataaacctatcggtagtggtatcggtctggctgtgtctaaagcaatagcaggtttaatgggcggtgatttaaccgttgaaagccaattgcatcaaggggcaacctttacgctcactttacaggctaaagctgtagaaaaaccggcagaaagcgaatctaatgtgcctaatacattgacgatcctattagttgaagatattgaggtaaatattattgtagctaaatccgtattggagaaattaggttactgtgtggacgttgccatgaccggtaaagaggctattcaaaaatttgagcaaaattattatgatttggtgctgttggatattcaattgcctgatatgtcaggatttactattgcacaatatttacgtgaaaaatatgaacaaggtgtttatgattttctccctcctttaattgcattgactgctaatattatgcaaagtaaaaccgaatatcaaaaacaaggcatggatgatgttttacgtaaacctttatctttagaggcgttagtaaattgtttatcggattatttcggtgatgagttaaatacaaagattattaaaaaatcctctttcgtagagttttctgctttatccgatgttcttaatatggaactgttggttgagctgaatgatattttaggtaaagaatttattggtaaaaacctattattatttaagcaaactatgccaagctatgtaaatgaattattagacagttatgaacaatataaacaggatagtgcagtaaaaaaagatttactttctaatgtacataaaatcaagggagcggcggcatccgtcgggttacttcgtttacagcaagttgcctctttggctcaagatgctaatcacgaaaattgggaaacgcatatcgatgagtggatcaataccttggcaaatgattggttggttgatacggcggcattagaggattggttgaatgatctgtaatttattaaggaataatagttgcaaaaaggggagtacaactttaaacttgagcctttgccattgatatagttaacactcgaataattatgacaaatttaactgaaaaactggaagaaactgccagcaataatgagcttttattaggtgagcgttttcgcatggctcgtgaaaaattacagttgtctttagatgatgtatctaaacaaattaatttaagacccgctattttacagcttcttgaaaataatgagtttacacataagagcattcctacaactttcatgaagggttatgtgcgtaattatgcgaagtttctacgcataccggaagaaatatggacaaaagcaatttcctccgtggaggaaaatacacgccataatttaggtaaaaatacttgcttgatgaaagcggtaaatgggcattcttctcatgggcgttggattggttatgtaacggtattggtgttgttgattgtatccggtatgacggcgttatggtggtggggaaattaccaaaaatcaaatcaagaacgtgacacttttgtacaacattatgtagaaaatgcaccatcggagcggattgaaattcaagcggatcaagtgcttgaaaaaaatttaacgatccctgtggaaaagccacaggttgtttctgttaatgaaactactgttgtaaataaagacagtatggcagaaaataagttgacctcagtttctacgcaagagcaaagtgcggtacaaaatccacaagaaatagtgagcaacaaaacatcagaaactgaaaaaacggttaaaaatacagaaacctttgtcggcggtgatttgcaaatagaaattatcggggccagttgctggattagtgttaaagacgctaaacataaagtattagcacaaaaagaatataaacaaggcgaagttttggtctttactgatggatcaccttattctttaattatcggtgccccaagcaatgttaaaattacttacaaaggtgaacattatccattaaaagttgacggacgtgttgctaaattcaaattacagtaaattattatgtcatcgtttaaaccaactattaatcgtcgtcaatcgacaaaaatttatgtgggaaatgtaccgataggtggtgatgcacctattgccgtacaatctatgaccaatacaagaacgactgacatagaagcaacagtggcacaaattaaagcattggagcgtgtcggtgctgatattgtgcgtatttctgtgcctactatggatgcggcagaggcgttcaaatcaattaaacagcaggttaatatcccgttagttgcagacatccactttgattatcgtattgctcttaaggtggcggaatatggggtagattgtttgcgaattaatcccggtaatattgggcgtgaagatcgtattcgtgccgttgttgattgtgcgaaggacaaaaatatccctattcgtataggtgttaatgcaggatctttagaaaaagatctacaggaaaaatatggcgaacctacaccggaggctttgctggaaagtgcgttacgtcatgtggaaattttagatcgtttgaacttcgatcagtttaaggttagtgtgaaagcctcggatgtctttcttgcggtagaaagctatcgcttattggcaaaagcaattaaacaaccactgcatttaggaattaccgaagccggtggagcacgtgccggtgcggtaaaaagtgcggtcggtttggggatgcttttagcggaaggcattggcgatacattacgcgtttctttagcagccgatcctgtcgaagaaatcaaggtcggttttgatattttaaaatctctacgtattcgttctcacggcattaattttattgcctgtccgacttgctctcgtcaggagtttgatgtgattggcaccgtcaatgcacttgagcaacgtttggaagatattgttacaccaatggacgtatccattatcggttgtgtggtgaacggaccaggcgaagcgttaatttcagatcttggagtaacaggcggtaataaaaagagcggttattatttagatggaaaacgtcaaaaagaacgctttgataatgaggatttaattaatcagttagaggcaaaaattcgtgcgaaagtcgcacagcaagatccaaaaaacagaattatctaaaggaagaatattgtggcaaaaacaattcaagcaattcgaggcatgaacgattgttcacctactgaaagtctcttgtggcagtgggtagaagaaaaagtgcggtcggttttacaaacttatggttattctgaagttcgaatgcctatcgtagaaagtacccctttatttgctcgtgctattggtgaagtaacagatgttgtatcaaaggaaatgtacacattttgggataacgatgaacaattaactttacggccagaaggtactgccggatgtgtgcgtgcggcaattgagcatggctggatttacaataatgaacaacgtctttggtatatgggacctatgtttcgtcatgagcgtccgcaaaaaggacgttatcgtcaattccatcaagtcggtgtagaagtgtttggtatagcgaatccggaaattgatgctgaattgattttattaactgctcgtttatggaaacagctgggtatttttgatcatgtaacgttacaacttaattctatcggttctcttgagtctcgacaaaattaccgttctgcattagtggaatttttacagcaacatatggatctattaagtgaggaagaaaaagaacgtttagtgaaaaatccactacgtattttagatacgaagaatcaggtgctacaagaagtattaaatgatgcaccgaaattattggattatttagatcaagagagtcgagaacattttagccaactatgcgatttattagatgccgtcggtattcaatatgaaatcaatcctaaattggttcgaggtttagattactacaataaaacggtgtttgaatgggtaacttccgctttgggggcacagggtacagtttgtggcggcggtcgttatgacggtttagtcgaacaacttggcggtcatgcaacttgtagtgtgggttttgctatgggattggaacgcttggttttactggtgcaagaagtgaataagcaaatcgttttaccaagtgcggtagatatttatgtggtttattttggtgaaaaaacgactttacctgcattccagttagctgaaaaaattcgtacggaattaccgcatttacgcacaatgacacattgtggtggcggtaactttaagaaacaatttaaacgtgcggataaagttggtgcaaaatttgctctagtgattggcgaaactgaggtgaaaacacagcaggttgtcgtaaaagatttactgggtggtgccgagcaattgagcttggcattaacagatgtagttatttacttaaaacaagcaattactcaataaggatactaaaatggcttatacaatcgaagaagaacaagaactgaatgaattaaagacttggtggaaagaaaattacaaatctattattgtaattgtgcttcttgccttttcaggcgtatttggttggcgttattggcaagattaccaaacaacgaaaaaacaaacactttctgcacaatatgatgaactgatcagcagtgccgaaaatcaaagcatctacaatgctcagctggatcggtttgtgcaagaaaatggagaaacaacttatgctgtgtttgccttgttagataaagctaaacttgaagtcagtcaacaaaattttgtgcaagcagaggaaacattaaagcaggctattgtgaatacgagtgatgatattttaatgtcaattaccgcaattcggctagccacagttcaatatcagttacaaaagtttgatgaggctttagcaagtcttaatcaagttaaaggtcaatcttgggatgttagcaagttgttattgtccggtgatatacagttggcaaaaggcaataaagagatagcaaaggataattttgaacaagcactaacaaaagccacatcttgggaaaaatcattcatccaagtcagattaaatagtctgtaattgtctaattattgaagccttgatacctcaaggcttttttataggaagttatttatcatgaatattcaacacttattgaaaacacaagcctatattaatggagaatttatttctgccaaaaatcaccgcacttttcccgtgataaaccctgctaatcaacaggttatttgtgaaattacctgttgtggtaaagaggaaacagaattagcgattaaaagtgcaaaacaagcacaagtacattggaaaaaatataccgcaaaagagcggtcgaaaattttaaagaaatggtttgaactgattatgcaacatcaggaaagtcttgcatatttattaagtttagaacaagggaaaccgcttagtgaaagtcgagctgagattgcttacggtgcaagttttgttgaatggttttccgaggaggctaaacgtgcttatggtgagattatcccccaagtgcgggaagaaaatcgcttactggtgattaaacaaccggtaggggtagttgctgcaataacaccttggaattttccaaatgcaatgatcacacgaaaagccgctccggcactggctgcagggtgtgccattattattaaacctgcaccggaaacgcctttatccgctttagcattggcagcattagccgagcaagcgggtataccgaaaggtatatttaacgttttaccgacagtatatgcagaagaagtcggaagtgttttaactcgaagtactgatgtacgtaaattaacgtttaccggttcgactaaaattggcaaaattttaatgcagcaatgtgccgatacggtgaaaaaaataagtcttgaattagggggaaatgcaccatctttgatttttaatgatgcagatttagacagaaccgtcgattctgttatagcctcaaaattccgcaactcagggcaaacctgtatttgtactaatcgaatttatgtgcagtcggagatttatcgtgcgtttgctgataaattaaaacaaaaagtgcgatcatttatcgtaggcgattttcagcaagaggcggtaaatattggaccgttaattaatgaaagtgcggtacgaaaaattgaacgacacattgaggatgcgttaagcaaaggtgcaattttaactttaggtgggcaacgccattctctaggaggaactttttttgaaccaactattttagaaaatgtgtcgcaagatatgttagtttgccatgaagaaactttttcccctctggcagcgttgattcctttcgatacggaagaacaagcaattagcatggcaaatgatagcgagttcggtttagctgcgtatgtgtatacacaagatttcagtcgtatttggcgactttcggaagaattggaatgcggattagttggagttaatgaaggcattatttccaatgaagtctctccgtttggtggagttaagcaatcgggcttgggtagagaaggctctcgtcacggactggatgagtttttagaaatgaagtatttgtgtatgaaagtttagtttacaatgcaacaagtcaattgattatccctgctgaggtggaaagtacgacaacacgtgtattaggatcggcaattacaagttttgaaactgcgagattagacatcagtaaattccttttagttaaggaaaggggctattgccccttatgataattattgacgcacagtatagtcgcctgaacaaacccatttgtaggtggtaagtgcttccaatcccattgggcctcgagcgtgtaatttttgtgtactaaccgccacttctgcccctaaaccgaattgtccaccatcagtaaatcttgtgctagcattaacataaactgcggcagcatccacaagggaaacaaattggtgagcaagtcttggtgatgacgttaaaattgcttctgaatgttgtgtgccgtactcggtaatatgtgcaatggcttgttgaatatctttgacaataacaacatttaaatccaatgaaccccattcttgacgtagctgttgttcttgtacaatagatacttctgcattttgtttttccaatattgaaagtgcggtcggatctgcgtgatattttacatttttgtgtttcaaatgagcgacaagcttaggtaaaaattctgtggcgatactttcttgcactagcagagtttctaaggtgttgcatgtactcggacgttgagttttagcattgtcgattacagccaaggctttatcttgctccgcactttcctccacaaatacatggcaaaccccaacaccgccaataatgaccgggattgtagagttttgtttgcaaaactcatgtaaacccgcaccgccacgaggaataatcatatccacatatttatccaatttaagtaattctaatacgaagtttcgatccggatcggtaatagcttgtaccgcatttttaggtaatccggtttgctccaacgcatcttgaattacttttaccaaaattttattggaataattggtttcttttccgcctcgtaagataacggcattacttgtttttaaacaaagtgttgcaacatcgacggttacatttggacgagcttcataaattacaccaataacacctaaaggcacacgaactcgttctaattttgtaccactttctaaaataccgccatcaatgatttgtccgataggatccgacaatgaaataatatgacgaacatcttttgcgatactatttatgcgttccttggtgagtaagaggcgatcgataattgcatcagataatccattttcttttgccagctgaatatccttagcattttctacaagaattttatcgctttgtaattccaattgttcagcgataatttgtaaggcggtatttttttgttgttgagaaagttgagccaaaatcgtagcggcttgtttagcattttttcccatttcttttaaactcatacaatatccttattttgtttttttaggtaatttatcatgcgttttgactttttctgctccttgctcttgataatcaaaaataggcaatccccattcgaaataaatggcgagcaaacgaataatgaagccactaattaacgtaataataatgaccaaattttgattaatctgtaattgttgtaagccaacataaataccggtagctaataatgcaacactggcataaagctctttttggaacactaaaggaatgcggttacagagcgaatctcgtaatacaccaccaaaggctcccgtaacgatagcggctatacaggtaacagtaaaaccatgccccatgtccaaagcaatttgagcaccaataatggaaaatacgatcaatcctagtgcatctaagaccaaaaaaatggtacggaagtagcgtataaagtgtttgataaaaggagctataaaaacagtgagtatagccgctccggtaacaatcaagaaataatgtgggtttttaacccaacccaagggataatgcccgagcaagatatcccgaatcgatcctccaccgatggctgtcattgaagcaataataataaccccaaaaatatccattttttctcgtccggcagccaatgctccggttatcgcttctgctgtaatgccgataatatagagaatactcagtaacataagtgtccttaaagtgcggtaaaaggattactattttagagtgcatagaacaaagaaacaatgttatttttgagctaacccaagaagttaggcggatttattgcaaggaaaatttaaccggataaaaaagaaattctcatatcatcaaatttagcaaggattattcattagaagaataaagtatttctttataatgtttacggcataccgacatataactatcatttccgccaatttgaatttgctcaccgtctttgactgctttaccttgttcatttaagcgtaaaacaaaattagctttacgtccgcagtaacaaatagttttcaattcttcaagttgatctgcccaagccaacagatatttgcttccttcgaataattctgcttggaaatctgtacgcagaccatagcataataccggaatattgagttcatctaccacattgcttagttgatagacttgtgctttcgttaaaaactgagcttcatcaattaaaatacaatgtaatttttgttgcttaatatgcagtgctatttcagtaaaaagatcagtgtctttatgaaataaattcgcttgtctatgaatgccaatacgtgaactcactttacctttaccaaaacgatcgtcgatggcagttgtataaactaacgtattcatgttacgttcacgatagttataatccgattgtaataaggttgtagatttccccgcattcatcgtggaataataaaaatatagttttgccattatgttaatacccaaccgccggaaataatatatattaagtttgatttttccattatttatcttaaattgctttcagttcagtcattgcccagcggggtttaacgtcaatttccaaaggtgaatattcaccttgttttagacgcaaaaaaccgacgtaagcaatcattgcaccgttatctgtacaaaattgaggttgagggtaaaagacctctccttttaattgtttcatcatatccgctaaagattgacgtaattgtttatttgcactcacaccgcctgcaatgactaagcgtttaaagcctgtttcttttaaagctcgacgacatttaattgctaacgtatctactactgcttgttggaatgcgtaggcgatatctgctttagtttgttcagtgagttcaccttcttgtttaattgcttgattaattgtattggcggcaaaagtttttaaacctgaaaaactaaaatctaagccggggcgatctgtcataggacgaggaaagaaaaaacgttcgggattcccctgttctgccaaacgtgaaagtacactccctccagggtaatccaatcctaataattttgccgttttatcaaatgcttcaccggcagcatcgtcaatactttctcccagtaattcatattgccctacagcattaacacgaacaagctgtgtatgtccgccggatactaataacgctacgaaaggaaattttgggggattattttctaacataggggcaagtaaatgcccttccatatgatgtacaccaatagctttaatgttccaagcataggcaagcgagcgtgcaattgttgaacctactaaaagtgcacccaccaatcccggtccacaagtgtaagctatgccatcaatgtcttttgcttctaatcccgcttgttgtaaagccgcctgaattaatggtgcggttttacggatatgatcacgagacgctaattcagggacaacaccgccataatcagcatgtaaagcaatttgagtatacagttgattggcaatcaatcctttttcttcatcgtaaatggcaacgcctgtttcatcacaagatgtttctatgcctagaatacgcattttgtttctcttctttattgaatttcgaaatagagtagattctaccttttttacttaaattaaactagcgtattgatttttttaagagaaaaagtgcggtatttaaaagtgcggtattttttagaatttttttattttttcgacatatctcgcaaaattagcttgcttattttctaaatgaatttttttgtattaacctcttaccagttatgagtacggaacaataggaaaaatatggataaccggaatgagctgttactgcgtttgttacaagtgccgaagttgggagcgtccggaataactcaacttttatcgcacatcgatttaaaaacattagaggattatgatgatgttgcgtttcattatttaggctggaaacctgaacagataaataggtggttgtatccggatcttagatatattgaacctgcattattttgggcaagcaaaaagggacattatttgatgaatttttatcaagagaattacccttatttattaaagcaaaccataggtgctccccctttgttatttatcaaaggcaatccggaaatacttgctcaacaacaagttgctattgtaggaagccgtcattgctcacattatggcgagtattgggcaaagtattttgcaacggaattgttccttgctggttttgttattaccagtggactggctttagggatagacggtttttgtcatcaggctgttgtggatattcaaggacaaactatcggggtattagggggaggtttggaagagttgtatcccaaacaacataaaaaattagcacaacaaatgctagattatggcggtgcgttagtgtcagaatttttacctcatcagcctcccaagccacaacattttcctcaacgtaatcgcattattagcggactttctaaaggtgttttagtggttgaggcaacagaaaaaagcggttcactcattactgcacgttatgctttagaacaaaatagagaagtttttgcacttccggggcaaattcaaaatgagtatagtcaagggtgtcatagattaataaaagacggtgcattgttagtagagaatgttgcagatattgtagaaaatttatcgccttttatgcattatgaacgtcaactaacagcaaaacagatagaaacgcaatttccgccggcttataagttacctgcttcaccgacttatcctgaactctatgcccatattggatatacgccggtagggcttgatgaattatcaaataaaagcggattaagtgtagataccttattgatacagctgttagaacttgaattgcaagatctcgttattgctgaaaaagggttatatcgacggacttaaatgttgatataagcgataactgacttgttttgtgtttttttcttttaataattgccaatttgcaggcgttgttaagcttttttctcgttctgtttccacataaataagtgcattggcatgtaaccaattatgctgtactagtaacttaatggcttgttcagcaagattaaagtagaaaggaggatcaataaaaacaatatcaaagtgcggttcggtttgagttttgtttaaatagtgcaaactattttgattaataacgtttgcattggtacattttaatatagcgacatttttattgagttgattagctattgttttgtctaattcaaggaatgtaacattttttgcttggcgtgaaagtgcttcaaagccgagagaaccgcttccggcaaagcagtctaaacaattggaatcaacgatatgaggcattagccaattgaataaagtttccttaacacgatctcctgttggtcttaaacctgtagaattcaaaacaggtaattttctggcacgccaaagtccggcaataattctgacttcccctttgtttttctcttgtatacggtttggttgattttttttcattaaaaattaattatgataaactaaatgcagtttcgtgattttaacagaaaagtgagcaattttatgtcagaagaaaagaaaaaaggtagattttggtcttggttaggattggggcagaaaacagaagattcgatatcagaacagcaaccggagcaacaatcaggacaacaggaaagtgttgcaagcgagcaagaatctacttcgaatatagagcaggttataaaagaaccagagcatattgatgacacttcatcagacttggttttatccgctcatttacaggagcaagaggtaaaagaatactcacttcatgaacgggaactgtctcaaaatactgtaatagaaatagaaagtgcggttgaaaaaacagatatttttattgaagaggatacaacatatcaggctatcaataaggagcagcgagaggaaacaacgattacatcggtaaaagaagtaataccgcaagaacaagaaaaaccggctgaaaatggtttttttagtcgtttagtcaaaggattattaaaaaccaagcaaaatatcggtatcggtttccgcagtttgtttttgggcaagaaaattgatgacgagttatttgaggagttagaagaacaactattgatcgctgatatcggtgtgccaactacgacaaaaatcatcaataatttaattcagcatgcaagccgtaaacaattgcaagaggcagatttactttatcaacaacttaaagtggaattagccgatattttaaaaccggtcgagcaacctttacaacttgataacagtaaaaaaccttatgttatcttgatggttggtgtaaatggtgtgggtaaaaccactacaatcggcaaattggctaatcaattccaaaggcaaggcaaatccgttatgttggcggcaggagatacgttccgtgctgcggctgttgagcagcttcaagtttggggagaacgtaaccagattcctgttattgcacaaagtacagggtcagattctgcttctgtcatttttgatgctatgcaatcggcagcggcacgtaatattgatgtacttattgcggatacggctgggcgtttgcagaataaaaataacctgatggatgagttgaaaaaaattgttcgtgtgataaaaaaatgtgatgaaacagcaccgcatgaaatcatgctaactcttgatagtggaacgggacaaaatgcaattagtcaagcgaaattgttcaatgaagcggtaggattaacgggtattagtctaaccaagttggatggaacagcaaaaggcggtgttatttttgcgattgcagatcaatttaatttacctattcgctatattggtgtcggtgagaaaatcgatgatttacgcccattccaagcagatgaatttattgacgcactttttgtacaagaagagtaaatgttgaaatacaaatcttagaatgatcatcttagatggcaagttattatttagcataaaacgtaggaaattctatactatcgttgactatgcctctaatgataggaagtgcggtattttttatatgaattcaatctagttttaaatcattttacttaacattacttagaaataagatgatgttttcggatgcccaacaatattaacatcacaaaataagttatcacagcgacgaaaatcagccagcccagccaatgtacacgagtgaaaaaggtcatttgtttccagagactgagtgctggtgaataataccaaataaccattcccataatgatcgcagagattaaaactttgacaaaaaagaccgcactttgtcgagtaaaatggtaaatatccgctttagctaatcctcgataaagcaagtaagcattcagtgttgctgacattgctgaagcgatagccaatccaatataactgaacgggatagcgagtaaattaaatcccatattacttaccatagcaataattccgatttttaccggagtttgggtatcttgccgagcataatagccattggctaaaattttaatcagcataaaactcaacaatccggcgttaaatgcccaaagggaataagaggcggcttgcacatcagaaaatgaaaatttcccacgcatgaacagtaccaataacatcggttgtgccaaaacagcaatgccaatcattgccggaatgccaaataataagatcattctgacgccccaatccattgtttgacgaaaatcaaccgcacttttttcaatgttatctgtacgattaacataatgtcgagatagagttggaagaataacggttgaaatcgcaataccaaataaaccgagaggaaattctaataagcgatctgagtaataaagccagctaattgatccagtcattaaaaaactggcaataaaagtatccaatagaagatttatttgatttacagaaacaccgaatagtgccggaatcatcaaggttcttattttttttacgccctcatcatgccaagcccattgaggttttgttaaaaatccggcttgttttaaaaaaggaatttgaaagagaaattgtagcaagccgccaataaagatcccgatagcaagagcaagatcgggactttctaatcgaggagcgagaaaaagagcggtgcaaatcatagctatattgagaagaacgggcgaaaaagacatcacgccaaatttaccgatggtatttaaaattgcaccagataacgccacaaaagtgataaaccataaataagggaaagtaattttgaggagtaaagaggcttgttcaaattttattgcattggagctgtcatttagccaatcaataaaccaacctgtgccaaagatcgccgtaattacaggagaaaaaagcattgctaataaggtcactactgaaaccaatccgcccaaagtacctgatactttacctataaattctctagttttacttaaatcgcctgatttttggtattctgctaaaactggtacaaaggcttgtgaaaaagcaccttcggcaaataaacgtcttaaaaaatttggaatgcgattagcaaataaaaaaacatccgccactacacctgcacctaatatttgtgcagtaataacatcacgaattaaacctaagatacgtgataacaaagtcattgcactgacgataatgcctgatttcaataattttttgctcaaaataagtttcctttcatgaaaaattggcttaattgtatataaattttgtttttaagctatattccaaacgaaaaaactgttagaattccgcctacatcgtaactaggctcaacaactaaaggcaattgaggaaagctaacgatggttgtttcggttgtgtctcaccgaaatcctcaacccaaattttgctaattgtttattgacaattgtatagaaaaaaggcatattttacgcctttattttttcgtaaactaacagatattttaggagtttgaccttggctaatatcaagtcagctaaaaaacgtgcggttcaatctgaaaaacgccgtcaacataacgcaagccaacgctctatgatgcgtacttttatcaaaaaaacctatgcagcagtagcaacaggtgataaagcagtagctcaagctgcttttgttgaaatgcaaaaagttgtagaccgtatggcatctaaaggcttaattcacgctaacaaagcagctaaccacaaatctaagttagcggcacaaatcaaaaaattagcgtaattttttaaaaccgataaaaacaaaaccgcactttaaagtgcggttttttatcagctgttgattaacgggtactggtactcgttgtcgtacggtttgcacgtttacgctctacctcagttaaaagttttttacgaatacgtacagaaattggcgttacttcaactaactcatcatcatcaataaactctaatgcttgttcaagtgtgagtttcaatggtgtggttaaagtcaaagcatcatctttacctgaagcacgcatattggtgagttttttaccctccagcgggttgacagttaaatcattagagcgactatgaataccaattatttgtccttcataaatttctgcaccatgatcaaccattagcttgccacgatcttgtagggcataaagtgaataagccaaggctttacctgtaccgtttgaaatcagtacgccgttaatacgctggccaatttcacccggttttacatcatcataatggctgaaacttgagtaaagtaagcctgtccctgaagtcattgtcataaattcattacggaaaccaatgagaccacgacttggaataatgtattctaagcgagtacgacctttaccgtccggtatcatatcacgtacttcacctttgcgaataccgagtgcttccatgacagaaccttgatgttgttcttcaatatcaatagtcacttgctcgaaaggctcttgcttgcgaccatcaatttctttaaaaattactttaggacgagaaaccgccagctcatagccttcacgacgcatattttcaattaatacggataagtgcaattccccacggccggatacactgaaaatatccgaatcatccgtttcttctacacgcaatgccacattatgtacaagctcttttttcaaacgctctaaaatttggcgggaagtgacaaatttaccttcttttccacagaatggtgaagtatttacacaaaagaacatagttattgtcggttcatcaacgcttaatgcaggcaatgcttccacattgttaatatcacaaacagtatctgaaatatttaactcacctaaaccggtaatggctataatatcacctgcataagcttcttgagcttcgtaacgctgtaaacctaagtgtcctaaaacctgaccgatacgaccgttacgggttttcccttcaggatcaattaatgtaacaggttgatttggttttactgtaccacgtttaatgcgtccaatcccaatgacacctaaatatttgctgtaatctaattgggagatttgcatttggaacggtgcatccaactcaacatccggcggtgaaacatgttcaataattgcttcaaagagcggatccatattagaagccaatttttcatgttcaagaccggctacaccgtttaacgcagaagcataaataataggaaaatcaagttgttcatctgtggcacccaaatttacaaagagatcaaatacttgatctactacccagtcaggacgtgctccgggacgatccactttattgattacaacaatcggttttaaaccatgtgagaaggctttttgggtgacgaagcgggtttgtggcattggaccgtcaaaggcatcgacaaccaacaatacggaatctaccattgaaagtactcgctctacttctccaccgaagtctgcgtgtcctggtgtatccacgatattaatacgatagccgttccaattaattgcggtatttttcgcaagaatagtaattccacgttctttttccaagtcattggaatccattacacgttcatcagtatcaccacgagaagtgtctaatgtgcctgaaagtttaagaagcttgtcaacgagggttgttttaccatggtcaacgtgtgcaataattgcaatattgcgtaatttttgaatatcaattttatctgtcatttgaataatctagagttataaaaaattaaaactttcttccgcactttacgtttcaaaatagttcatttttacatctataccgtgcggaaaggtcgccgattatacaactttttgttattaggagctataaaaaaacgacctccgacctttaccgatataaaattccctatcctattcccctctaattgattataatctccgttcaaatttatttccgttcccactaaagtagagagagtattatgtcaaacacaacagctattacgaatgtattcaagttaatcgaagaaaatgatattaagtttgttcttcttcgttttaccgacgttaagggtaaagaacatggcgtttccctgccggtcagtttagttgatgaggacttgtttgaagacggtaaaatgtttgatggctcctcagttgaaggttggaaagccataaataaggcagatatgttattgatgccaattgctgaaaccgccgttgttgatccttttgctcaaattccgacactttcaatccgttgcagtatttttgaaccgactaccatgcaaagttatgacagagatccacgctcaattgccatgcgtgcagaaaattatatgcgttcaacaggcgttgcggatgatgtattttttggccctgaaccagagtttttcttatttgatgatgtgcgttttgatgtctcgatgaacggtaactcttatactgtcgacgatattgaggcagcatggaatacaaataaacactatgaaggtggaaataaagcctatcgtcctttgaagaaagggggatattgtgcagttgcaccgaatgatatcgcacatgatattcgctcggaaatgtgtttgttaatggaagaaatgggattagtgattgaagcccatcaccacgaagttgcaacagcggggcaaaatgaaattgccactaaatttaatacacttacgttaaaagcagacgaaacgcaaatttataaatatattgtgcaaaatgttgcgtatgaacatggcaagacagcttgctttatgccaaagccgattataaacgacaacggttcaggtatgcattgcaacatgtctttgagtaaggacgggaaaaatattttccaaggtgataaatatgcagggctttctgagaccgcactttatttcattggggggattattaagcatgccaaagccttaaatgcgtttaccaacccatcaaccaactcttataaacgcttagttccggggtttgaagcacctgttttattggcttattcagcaagtaaccgctctgcatcaattcgtattccggcggttactaatcctaaggctattcgtattgaagcacgtttccccgatccgttggctaacccatacttagcgttttcagcattattaatggctggtttagacggtattcaaaacaaactttatcccggtgatgcaatggacaaaaacctctatgatttaccgccggaagaactgaaagacattcctgccgttgcaagttcattgagtgaagcgttagataatttagaaaaagattatgaattcttaacgcatggtaaagtgttcagcaaagaatttattgatacgtttattgcaatgaaacgtaaagaagtggaacgtttaaatatgacaccacatccagtagaatttgaaatgtactacgcttaataccggttagataaacaaaaagcgactaaatttgtttgatctgacctcacaggctagacagatttaatgcaaggactgtgttatatcatttacaggtcgcagtccttttagtttcacgtgaatatattcaaattgttgtaataaagtatctgaaatttttccgactttactctgataagaggatactttcttcgctggcaattcttaattttataccgcactttttactctttttttctcagcgaaacttctcctccgttaaattttctcaacactccattattcaacgctactaatagataaccctcttcatcaataccttgctcaattccacaaacgatttctttttcgctaataatatttacttcttgtccaaaaaaataatccaacttaatccaacgctgaaaaaaagcatgcattccctgttgctcaaaaatagtcaaatattgataccatttttttactaattgaattgcaagatcattacgatctatttccggcaaagtttccaataattccgcccaaggttgatcaattttgttttcttgcggtaaagataaatttatcccaatgccaacgataaaattaagtaatccatttttagcattgacgatttcaactaaaattcctgctaatttccgtccgaacaatagcagatcattcggccattttaacttaacctccgcacccatttcatttagcacttcagcagttgccagccctaatactgaacttaaaccgtttaacgaaactgtcggattgaatgtccaataaaaactcaccattagttgaccggcaaaaggcgattgccattcccgtcctcgtctacctcgccctgcaaattgatattcggtaaaacacaagtctcctttgttcaactgtaaaatgttttccatgagatactgattagttgaattgataatagggtgataataaatcttataaggacttaattctgtttccaaataagatagatttaataaaggaagttgcggttttaaagaaatattttgctcattatcaacaatacaaattccttgttgtcttaattgtgctatctgcttttccagttgtactcttgtcaggtctaaaagtgcggttaaatttttgtaagaatagggtttgcatctagctaaaatagataacaacttaatcatttttccctcgctatcaccattataaaatctcaagcagcagtacttttaacacaaattttttcaagagaaaatattataaaaaaacattttcaaacaagtaggagatctgtataatttgggcgcaatattttttgtcctttttaattttaatagagagaatattgcactatgttacgagtaattaaagaagccttaacttttgacgacgttctattagttccggctcattctacagtacttccaaatactgccaacctttcaactaaccttaccaaagaaatccgtctaaatattcccatgttatccgccgcaatggataccgttaccgaggctaaattggctatttctttagctcaagagggcggtatcggatttattcataaaaatatgaccattgaacgtcaagcggatcgtgtgcgtaaagtaaaaaaattcgaaagtggaattgtatctgaaccggttaccgtttcgccaacaatgacgttaactgaattagcggaattggctaagaaaaacgggtttgcaggttatcctgtagttgatgaacaaaaagggttggtagggatcattacagggcgtgatacacgtttcgtttcagacttgaataaaactgttgcggattttatgaccccaaaagatcgtttagttactgtgaaagaaggggctactcgagaagaaattttccatttaatgcacgaacatcgtgttgaaaaagtgctggtagtggataacagctttaaactaaaaggcatgatcaccttaaaagactaccaaaaagccgaaagtaagccgaatgcgtgtaaagatgaatttggtcgtttacgtgtcggtgccgcagtcggtgccggtcccggtaatgaagaacggattgatgcgttagtgaaagcaggagtagatgttttgttaatcgactcatctcacggacattccgaaggcgtgttgcaacgggtacgtgaaactcgtgctaaatatccaaatttacctattattgcagggaatattgcaacagcggaaggtgcgattgcattagctgatgcaggggcaagtgcggttaaagttgggattggaccgggatcaatttgtacgactcgtattgtaacaggtgtgggagtgccacaaattacggcgattgctgatgctgctgaagcattgcgtgagcgtggtattccagtgattgccgatggtggtatccgctattcgggtgacatcgctaaagcgattgcagcaggtgcatcttgtgttatggtcggatcaatgtttgcaggaacggaagaagcaccgggtgaaatcgaactttatcaagggcgagcatttaaatcttaccgaggtatgggttcccttggtgcaatgtcaaaaggatcttccgatcgttattttcaatccgataatgccgcggataaactagtgcctgaagggattgaagggcgtattccatacaaaggatttctaaaagaaattatccaccaacaaatgggtggattacgttcttgcatgggcttaaccggctgtgcgactatcgaagaattacgcactaaagcccaatttgtacgtatcagcggagcaggcatcaaagagagtcacgttcacgatgtgaccattaccaaagaagcaccgaattatcgaatgggctgatataacaaacggttggtttttgcaaaatttgcagaatttgtgtcgcttgtactgagataaggagcataaaatgaaaaaattaggtttgatttctatactgttattgtccggctgtggcatttttggtccatcatattcagggcaaacaacagcagactggttattaaaatcagatacagaaagcactattaggctatattttcgtgctataaataattgtggaatagaaaaaatccatacggaaatcaattcaataccgagtgcaggtaatgtaaatgaaacttggactgtaacaggctgtaatataacaaacgtttttaatgtgaaatatgttagtgacggtcatggcgggacttactttcgcgtatctaaaaaataaactaaaactttaggaaacaaaatgacaaatatccatcaccataaaatcctcattttagatttcggttcacaatatacgcaacttatcgcacgtcgtgtacgtgaaatcggggtgtattgcgagctttgggcttgggacgttacggaagaacaaattcgtgagtttaacccaacaggaattattctttcaggcggaccggaaagtacgactgaagcgaatagtccacgtgcaactgaatacgttttcaatgcaggtgtacctgttttaggtatttgctacggcatgcaaaccatggcaatgcagttgggcggtttaacagaaacttctacgcatcgtgagtttggctatgctgaagtttctctacaaaatccgaccgcactttttgcagatttaaacgatgatctgaccgcttgcgatccaaaattggacgtttggatgagccacggcgataaagtgactcgcctacctgataatttccaaattacaggcatgacctcgacttgcccgatcgcggctatgtcagatgaaagccgtcgtttctattgcgtgcaattccaccccgaagttacccacacaaagtgcggtcaaaaattactgcaaaattttgtggtagatatttgcggttgcgaaaccaattggaccgcagaaaatatcatcgaagatgcagtggctcgcattaaagcacaagtgggcgatgatgaagtaattttaggcttgtcaggtggcgtggattcatctgttaccgcacttttattgcatcgtgccatcggtaaaaatttacattgtgtctttgtcgataacggcttactccgtctaaatgaaggcgatcaggtcatggaaatgttcggtgataaattcggcttgaatattattcgagtagaagcagaagatcgctttttagaagcattaaaaggaattgatgaaccggaagcaaaacgcaaaactatcggtaaagtattcgttgatgtattcgatgatgaagcaaaaaaattaactgacgtaaaatggttagctcaaggtacgatttaccctgatgttatcgaatcggcagcaagcaaaaccggaaaagcccatgttatcaaatctcaccacaatgtagggggattacccgattatatgaaattaggtttagttgagccgttgcgtgaactcttcaaagatgaagtgcgtaaaatcggcttggcactcggcttgcctgcggaaatgcttaaccgccacccattcccaggccctggattaggtgtacgtgtactgggtgaaatcaaaaaagaatattgcgatttactgcgtaaagccgatgcaatttttatcgaagaactgcataaagcagattggtactacaaagtcagccaagcgttcggtgtcttcttgccggtaaaatctgttggggtaatgggcgacggtcgtaaatatgattgggttattagcctaagagcggtcgaaaccattgactttatgaccgcacattgggcaaacctaccttatgatttattaggcaaaatctcaaatcgcattatcaacgaagtcaacggcatctcccgtgtagtttatgacatctcaggaaaaccaccagcaacgattgagtgggagtagctaaaaatctaaagccttataaatagacattttgtgagtgttgtgcttgcaataaatcacctgaaggataattcttcgggtgattatactattaattcagggactgtattagattagccctaaatgacacacattttcgtagtgtttttaactgctctttagatattccaaagacttacattccttcaaaaataaaggagagtttattcagtcaattccattgtattttcagagtattcgtttggcttagcccccaaattttctatgtcgttgatgtagtcttgtttgactgcccccgaaatgataaattctttcgtggtgaaattcacttacatcaagggctaaatgataacggattagctcatggatgtttcgataaaacaaggcacttgaatttggattgatacctaaaatattagctgctgatcgagctgtcacttctaacacaaaaaagtcaaggagctttttctgtatagatttctttaatttacaatgagttattttcatttttatagactagcatacttactaatctaatacagcccctttttttatattgatgagtttgatagatagacactatcctaaaaaatcacaaaggcagcttgattctacaggtgataagattggaaatcggaagcttggtagagaagtaatttaaaagatatatcaatatcataattgcccgaattttcgctaaaaacgtaatatcgggcaaattatatggcattgtaaagagaataaatgtgaagcagttcacattctatacacaaattattgctgtatgatgaaataatttgttttattttatatgagaattgaaaatatatttcaaacttgtttcgtaatatataaagaggagtttgttatatgaatagtaaatttaccccccccctctccatttccacgcctgttgggaatctattaaacagcatcaagttcctgaatggtatgaagatgctaaattcgggatttttattcactggggaatttattccgtccccgcgtttgcaccaccgacttgtcaattaggcgagatcgatattgacgagcaatggttctgtaacaatccatatgccgagtggtatttcaattcaattaacgtcaaaaaaggtccgacttacgagcatcatatcaaaacctatggtgaagatttcagctatgaacagtttattccacaatggaaagcggagaagtggcaacctgccgaatgggcggagctgtttgccaaagcaggtgcaaaatatgtggttctgacgactaaacaccacgacggtttttgcttatatccgagtaaatataccgatttcaactgcactgaagctggtccacaacgtgatttgatgggcgagctgactgataatgtgcgtgaaaaagggctgaaaatgggagcttactactctggtattatagactggacctactcttctgcaccgattttcaccgagagtcaaaacttttccaatgcttgcccaacctatgaatacgccgattacgcttataaacaagtggttgagctgattgataaatataaacctgatgtactttggaatgacatcggctggccgaaagccggtgaacatatgcttccgcacttgtttgcacactactacaacagcgtgccacacggtgtggttgatgaccgttggaacaagctctggtgcgatttcacctcaaaagagtacaaacacggcgtggcttcgcgtgataaaaaatgggaaatgtgccgtggtatgggcttatcatttggttacaacaaagtggaagatgaaagccacttgatttcagtgaaagatctgatttcgctcttagtagaaaccgtggcagacaacggtaacctgttgctcaacatcggcccaaaagcagacggtactattccacaagagcaagttgaacgcctactcgctttgggtaaatggttggagcaaaacggtgaagggatttatcgctcccgttgcagtaaatattcccccgaaactgtaaacggtgtaacaatgattgcccgccctcagatcgaccaaaatcgcacgtcttaatcgttccgagtgctgtatcgttacaacaaacagcggctgtttaaggaatccatcagcagcgtgggcgtgttgaaaactgtttgcattccttaaaaaaatacatataataataatttttatttgcatattttatataatataagaaaggatataggtaaatgacctctttcaaattattaggcttttcggtcttgagtgtggctttgctctctgcctgctcttccggcaaaggtggctttgatttagacgacgtcgagcatacccccccctcctcctcgggtagttcccgccccacttatcaagatgttccgactggacaacggcagcaagaaatagtagaagaaatcaactcacctgctctaggttatgcgacagaaattccgcgtaggaatatttcgccaatgcccaccacgggcacaaaagaaagtaatgctcgtgttgccattactgcccagcaagttgcccctcttagcatgccttttaattcaataaaagaagattttatcaaaaggctaatagcagaaaacaccaagaaaaatgcacgaggtagagatgtaaaatattttgatgatacagatgacgtgttgtttgcacatgatggatctaatttagcgcataaacgtgatttacaatatgttcgagttgggtatgtgttgggtacccgaaagattgaacttgttttttcccatgataaaaaaacaagagatcaatttcctgctggttgggtaggttatgttttttaccaaggcactagccctgcggttacattacctacacaaaccgtaacatacaaaggctattgggattttgttagtgatgccttcaatgaacgaactttagctgaagattttacacaggaaaatagttctgctactagcaatataccgggcaatcaaatcggtgcgacttcaatggatgcattggttaatcgcaaagtttcaggagaaaaaatcaatattgctcacagtgctgagtttactgctgattttggcagtaaaaaactttcaggtgaattaaaaagtaacggttatgtttctagaatagaaaatgagcaacaagatgtaaaaacacgctacaaaattgatgctgatatcaaaggcaaccgttttgtcggttcagcaacagcacaagaaaaaagtcacaccatcttcggcaaggatgcggacaaacgtctcgagggcggtttctttggtcctaaagccgaggaactggcaggtaaatttctgaccgatgataattccctgtttgtcgtctttggtgcaaaacgtgaaagtaaaggcgatgaaaaactagaaacccgctttgatgccgttaaaatcagcacggatagtaataaattagaaaaagaaacgatggatacgttcggcaatgcggcgtatttagtgttggacggcagacagtttcctttggtgccggaaagtaatgccggtacgacgggcgctggcaacacaggcaagaatgagtttatcagcaccatagacggtagccatttaaacaaaacaaatcatgaaaaccacaaaaaatacaaagttaccgtatgttgcagtaatttggtgtatgtgaaattcggcagctatggggaacaaacaacagcaaacgatgcttcaaacagcactgccggtgcagcaactacgcataacagcacattaacaaacggacaccttttcctaacaggtgaacgtacttcgcttactgatatggcgaagcaaagtggtgcagcaaagtatattggcacatggcaagccaactttttaagtagcaaaggacaggttggcagtgttgacgccggtgatccgcgtaacgatagtggtaaaagccgtgctgaatttgatgttaattttggtggtaagacagttacaggcaagttttttgatgccgacggtattcaacccgccctcacaatggatagtaccaagattgaaggtaacggcttctcgggtacagctaagacaactggtagtttgcaattagataaaggcagtacaggtgcgggtataacagtaaccttcaccgatgctaaagtcgatggcgcattctacggtccgaatgcagaagaaatcggcggtaccatcacatcgaatggcacgggcgataaagtcggtggggtgttcggtgcgaaacgccaagaactatcgcaacagaaatgaaatcttaactctagctacctgaaacatatttcaggtagcaggatgggtatctgctgatatgctcaacctgcttgaaaaagtttgtcaaatccgtcgcctgtcgttgttgacggtgtgatgttgcagtggcaaatcgctcggctctgttgagaaagcatgacccatccgtcttttacttacacggaatgaaaaaaatgtctacaaaacctttgtttaaacttaagccaataacattggctatcagcacgatttttttaccttttactgaggcggttgctgatactgaatcaccgagtagcaatacagaagcagtgctggagttagaagctatccaggtgcaagccaaacacgagatcagcagacatgacaatgaagtcaccggtttgggtaaggtggtcaaaagcagtgaagacattgataaagaactgattttgaatattcgcgatttgacccgttatgatcccggtatttcggtggtggagcagggacgtggtgcaacgtcaggctatgcaatgcgtggtgttgacagaaaccgcgtggctatgttggtggacggcttgggacaggcgcagtcgtattctaccttgaaatccgatgccaacggcggggcgattaatgaaattgaatatgagaatattaagtcaattgaattgagcaaggggtccagttcggcagaatacggtagcggtgccttgggcggtgcggtagggtttcgtaccaaagaagctgatgatgtgattaaagaggggcaaaactggggcttgaacagtaaaacggcttacagcagcaaaaacagccagtttacccaatccgttgccggtgcgttccgtgtcggcggttttgacagtttggcgatttttacccatcgtaaaggtaaggaaactcgcgtgcatcctgccgccgaagaaatacaacatacttaccaaccattggaagggtattttaatcggtatgatgttgaccaaagaaacggaacgcctgttcgggcgtatgcgtattatatacttgccgatgaatgctctaatctaagtgatccgaattgtcgtcatgccaaggccaagacgaatagggtgggtgccccggagaacaatcctaaatggacgcccgaagagcaggcacaggctgctaaaatgccgtatccgacacgtaccgcctctgccaaagattatacgggtcctgaccgcatcagccctaatccgatggactaccaaagtcgctctttcttttggaagggtggttaccgcttgtcgcctaaccattatgtcggcggggtgttggaacatacgaagcagcgttacgatatccgtgatatgacgcaacgggcgtattacacgaaagaggatatctgccgcagcggatccagttgccaaacgttggataaaaacgatacggacaaaggtaatttcggtatcacgttgactgataatcctttggacggtttggtatatgatgccggcaatcaagctcgtggcgtgcggtacggacggggtaaattttttgatgaacgccatacgaaaaatcgctcgggtattttttaccgctatgagaatcccgataaaaattcttgggcagatagcttgaccttgagtattgaccgccaagatctcaaactgtcgagccgtatccattggacgtattgcaccgattatcctcatgtggcacgttgccgtgccagcttggacaaaccttggtctaattaccgtaccgagaaaaacgattatcaagaacgactcaatttgggacaattcaattgggaaaaaacttttaatctgggctttaccacgcataaggtgaatatcgccgccggctttggtacacatcgctccaccttacaacatggcgacttatatgctgaatatgtcaccttgccgccgtatgaggaaataaaagcgtatgatgataaaggtgcctttaaaacagatacgacccctgaggataaattacaattcggcaatggttcttatgacaaacctcgcgtatatagacgtaaaaacacgccggaattaaaaactgtcgatgggtgtaatgcgacagcaggtgacaatcgcgactgctcgccacgtgtgattacgggcagacagtattaccttgccttgcgtaaccatattgcctttggtgaatgggcagacttggggttgggcgtgcggtacgacaaccataccttccgctcgactgacccgtggaccaaaggtggcaactaccacaactggtcgtggaatgcgggcgtgagcctcaaaccgacccgccactttgtcgtgtcttaccgtgtgtccagcggtttccgtgtccccgctttttatgagctgtacggcgtgcgtacgggggcttctggtaaagacaatccactcacacaaaaagagttcttgagccgtaaaccgttgaaaagcgaaaaagcctttaaccaagaaattggtttggccgttcagggcgattttggtgtgatagagaccagtttcttccaaaacaactataaaaacctgcttgcccgtgcagataaacatgtcgagggattgggttatgtaaccgatttttacaacacccaagatgtcaaactcaacggtatcaatatcttgggtagaatctactgggaaggcatcagcgataggctgcctgaaggcttgtattccacacttgcttacaaccgtatcaatatcaaagcacgcaaattgcacgacaattttaccaatgtgtctgaaccgacattggaagccgtgcaaccgggacgcattattgcaagtatcggctatgatgaccctgagggcagatggggccttaatttaagcggcacctactctcaagccaaacaacgtgacgaggtggtcggcgaaaaagtgttcggcaagggtggcagcattaaacggacgatcaacagcaaacgcactcgtgcttggtatatttatgatttgacggcatactacacttggaaagaaaaattcacgttgagagccggtatctataatttaaccaatcgtaaatatagcacatgggaaagtgtgcgtcagtcctctgccaatgcggtcaatcaagacctaggtacacgttcggcacgttttgccgcacccggaagaaactttaccgtgagtatggaaatgaagttttaattaaaaaactgtctgcaagctgtttaaaaaacagttaagatgatttgttcgtataaatagctgcctgaagtcttgttatgcaggttcaggcagcttgacattccaaaaaaaggaaaaaagtctaatggaagacaatacgctatttgtcggcaacgaaattaggcaccgaaaaattgttgcaatggattagcagttcaagtggcttccggtattttttatcgcactttttctatctataagcttgaaatctttatttccgaacttatattttcgctgtttgttaatttcactattggaaaaggaaatattatgtcaacaaatcaagaaactcgtggttttcagtctgaagttaaacagcttttacaattgatgattcattctctttattcaaataaagagatttttttgcgtgagttgatttccaatgcgtctgatgcggcggataaattgcgttttaaagccttgtctgcacctgaattatatgaaggagatggtgatttaaaagtgcggatcagttttgacgcagaaaaaggtacgttaaccattagcgataatggtattggtatgacgagagagcaggtgatagatcatttaggcactatcgctaagtccggaacaaaagaatttttggccgcacttggacaggaacaggctaaagatagtcagttgatcggacaattcggtgtcggcttttattcggcatttattgtggcggataaagtaacagtgaaaacgagagcagcaggtgagccgatagatagagcggtgttgtgggaatcagccggtgagggtgaatattctgttgctgatattgagaaaagagaacgtggtacggaaattactttgcacttacgtgaagaggaaaaagagtttgctaatgaatggcgtgtacgtgaaattatcggtaaatattctgatcatattggcttgcctgttgaaattttagcgaaagaatatgatgaagaaggtaaagaaacgggaattaaatgggaaaaaattaataaagctcaagcactttggacaagatcgaaaggtgagatttctgatgaggaatataaagagttttataaacatttaagccatgattttgctgatcctcttttatggacacataataaagttgaaggaaatcaagaatataccagcttgctttatgtgccgtctaaagccccttgggatttattcaatcgtgagcataaacatggtttgaaactttatgtacagcgtgtatttattatggatgatgctgaacaatttatgccgaattatttacgctttatgcgtggcttaattgatagcaatgatttgccgctaaatgtatctcgtgagattttacaagataataaagtgacagctgctttacgtaaagcattgaccaaacgctcattgcaaatgctggaaaaattagccaaagatgacgaggagaaatatttacaattctggaaagaatttggtttggttttgaaagaaggtccatcagaagactttgcgaataaagaaaatattgccaaattattgcgtttcgcttccagtaaaaatgatagctcagaacaaaccgtttctttggaagattatgttgctcgtatgaaagaggggcaaaaggcaatctattacatcactgcagatagttatattgctgctaaaaactcaccgcacttagagctgttcaataagaaggatattgaggtgttgttgttatctgatcgaattgatgaatggatgttaagttatttaactgaatttgacggcaagcaattacaaccgattactaaagctgatctggatttaggtgatttagcggacaaagaacaggaagagcaaaaagagcaggataaaacatttagttcgtttattgaacgagtaaaaaccttgttgggagaacgtgtaaaagatgtgcgtttaacgcatcgtttaacggataccccagcagtggtttctactgataatgatcaaatgaccacgcaaatggcaaaattatttgctgcagctggacaacctgttcctgaagtaaaatatacgtttgaacttaaccctgaacatcatttagtgaaaaaagtagcagattttgctgatgaagacgaatttgcaaattggattgaattactgcttgagcaagcgatgcttgctgaacgtggttcattagaaaatcctaccgcatttattaagcgagtaaacaatttattggggtaatggttgtttcttagctgattgatgtaataaaactctctaatttattagggagtttttttatctatgtttgacacttgtagtaaaaaagtgcggtagtaaaatagcatttgaatagttaaaaaaatgctaacaatggaattttcacgtataattcgaagtcgggttttattgactttttattgaaggattgttgatgaaaaaaattatcttctttggaactgttatttggctaactgcttgtaccacaaccaatttatcatcaagttgccagcgttattttagtgtactggaaaaaaatatggcacaattttccctatcaagttctgaactgaccaagtttaaacaaaataaaaataaattaagtcaattgccggaaaaagaacaaaataaaatttgccttttaagaatggcaaatattcaacagtatagaaattgattgtttctgatgtgttcaagtctttttatggaataaatatggctacgttcgtcgcttggggcaatattcaacaatattatccttttgaaacaatacctttgcggttgctaaataaacacctaacgcattcagcaagtaactataaacctgtgcagcaacgttatcattgtcgccgtttagcacattttttattgtggcaattgttacaaaaagctggtgttaataccgcacttttaggtgatattaagcgttctccatccaatcgtccttactttttacaagacaatattgattttaatatcagtcattctgatgattgggtagcagttgttttacaagttgatgaaaataatgataaaagtgcagtaggaattgatattgagtttgtcaaaaaaacaagaaattacaccgcacttttacagcattttgccagccagcaagaggtgatttggtttcaacaaaagccttgcgaggcacgtttttatcaaatttggtgcggacgagaggcattgttaaaatcgcagggcgtaggtattgtcaaattatcggaagtcaagcatgaaccggagaaattattacttcactccgattattgcccaacgggaaagctcatatttacagctgagttgcctttttattttgcacttttttgtcatcaacatattgaacaaacacaatattttatgtggcaagataaccggtttgtttcaaaaaaactgacgcagacaattgaatatcaagtgaatcctttaaagcagttcattcaaatttaaagtcggttttcgttgcataatgaaaatgaggtagagtattgctcaaattgaatttacgaagattaaattatcaaaggacaacagagtcatcgtgaaattgcggtagaaattcaggactttttaagtggtaacaaaaagcctcatcaataaaaatgaattgataaggctagaaaatttggtggagataatcgggatcgaaccgacgacctcttgaatgccattcaagcgctctcccaactgagctatatccccgtaaatcgaatgtggcggctatgataaattccgccacttgtgctgtcaatatagaatattaaatattttttttactagattaaatattaaacattttgtgtatgaataaacgcaattgcattatttattctgctaattgtgcgatctttaccgaccaatttcgctgtaatatccattgacggtgattgtcccaaaccggttactgccaatctaaatggcattcctactttacccataccgatatcaagctcttgggcggtttggctcattacttcatgaatattttcaactgtccagtctgaaagtgcggtgagtttttctgccaatttagctaacggtttaatcgcttcaggcttgaagtttttagcaacagctttttcatcatagttttcaacatcttggtagaaataacgacttgagatggctaactcttttaatgttttgcaacgttcgcttaaaacgggaataatttcagctaagttcggaccattgctataatctatgccgtgttttttcatatgccattctagatgggttgcgacctgctctaccggcagagaacgtatataatgctggtttagccattgtagtttttcagtattgaatgcacttgctgatttgctaaccgaatgaatatcgaaaagtgctatcatttcttctcgactaaaaatttcttgatcaccatgtccccatcctagacgaacaagataattgattagtgcttcgggtaaataaccctcatctcgatattgcataacacttaccgcaccatgacgcttagataatttttgaccatcatcaccgttaatcatagagacatgagcataagttggaattggtgctcccaatgccttaagaatattaatttggcgaggtgtattattgatgtgatcttcaccacggacaacatgcgtaattcccatatcccaatcatcgacaacgacacagaaattataggttggcgaaccgtctgtgcgacggataattaaatcatctaattcacgattgctaatttcaatacgcccacgaacggcatcatcgaaaacaactgtaccttccgtcggatttttaaaacggacaacgtgaggtgcatcaactgggtattcactttgatgtaagcagtagcgatcatagcgaggtttttgtttattttgctcttgactatgacgtaggtcttccaaacgttctttagtacaataacaacgataagccaatccttgctcaatcatctgatcgattacttggttatagcgttcaaaacgttttgtttgaaaatacggtccatgttcccacgctaaattaagccattccattccctctagaattgccgctgttgcttcaggggttgaacgttctaaatccgtatcttcaatgcgtaatacaaattctccttgattatgcttggcatacaaccaagaataaagtgcggttcttgcaccgccaacatgtagatagcctgttggacttggtgcaaaacgtgtacgaactttagtattgggatctaaattaaaaagtggttctaatttcattcattttgcctttatttaatcaatcataaaacggtgcttattgtacaatgagttatttaatttcataagaaaaaattaaaattatgtttatttttaagacagttaaatagaaatccataaaaaatcattgactgttttttgataattcttataatgcacctcgcacaatacaagggcgattagctcagttgggagagcacctcccttacaaggagggggtcactggttcgagaccggtatcgcccaccactattctatagtgaactttgtattgtaatattggcttaaggggcgattagctcagttgggagagcacctcccttacaaggagggggtcactggttcgagaccggtatcgcccaccactttagccgaaattcccatttaactttaggtcaaatccgatagctgaaaagcgatttgattctatcgggcgattagctcagttgggagagcacctcccttacaaggagggggtcactggttcgagaccggtatcgcccaccacttcaaaaaatctacatttttccgtgtcgtcaaagtcattgcaactttcgggttgttgtcttttttatttatatttttaactaattattgttcacttttgcgatcttgatcgtaaaactacgatacttgcaaaaaagttttttcctgattccattaaaattattttttatttaacgaataggaaaacatatgcagaatttgaagctattttcttggaaagccactaattttttacagcaaaaacaagctggaatgcttgttatcgaaaatgtacaagaggccaaacgctatttattacaacaagggctaaacaatatatatttacagcgtcattggcaactgaataaaaagcctaaaaaaatagaattttgtgatctattaactcaattagcaatgttattacaatcctcaattcctttaaaagatagcttacaaattttattgagaaattgtgttaatatttctttaaatcaatgggttagatatattttaaaaaatcttgaaggaggattatctttttcacaatctgtggctcaatcaggtctatatttttcttatcaagaacgccaactcatttctgttggagaaatgacgggagatttagcctctgtttgccaacaaatagcagaacatcgtcagcaggcattagcattacaacgcaaaattcaaaaaattttactctatccaatgatagtcttaagtatttctgtcattctcaccgcacttctattaatttttatcgtgccacaatttgccgaaatgtacggttctaatcaatccgagcttcctttttttacgcagctattgttaaacatatcctcttttttacaacagtatttttttcatatgatagcggtatctattttatttttttatctaataaaattacgtttacacaattcatatagttttcaactcaaaaaagattggtttttatcgcatgtgccgttgttaaataaaattattcggcttaatagaacgataagtttttgccgtagtttaggattaatgctcaactcaggcattcctttacaacaaagtctatattctttccttccccaaaactctatcaacatacagaaaaagattgagggagatctcacgttaattaatgaagtaaagctaacattacgtggtatcgaacaaggatataaattctctcagtctgtaagcagtaatttgttttctatacaaacacaacaaatgctacaagttggtgaaaagagtggaaatctaggtttaattctgcaacatatcgcagaaaatcagcaacaacagttagatcatcaaattgatttactttcacaaatgttagaaccgtttatgatggtgatcattggcggattaataggcttgattatgttaggtatgtatttaccaatctttaatatgggaagtttaattcaatgatttatctggcttatatgttgtttggtggactttgtggcttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcggttatttaattttttgccttgttttagtggattggctataccaactcgtttcacaaaccttatgccaagccctatttattttagggttattgggtgcttatcaaggtattagcccattgactttggagcagtctttaattggtagcttatcaggcttttcggttttttatcttatttacattgttgcaaaattattctatcgttatgaagctttaggacgtggcgattactggttaatgttagggttagggagctttatatcttggacaaaattaccgttgctcatttttcttgcctgcctcacaggattaatatatgtcgtttttaatgcaagagacaaaaaaacaatatttattccttttgccccattcttatgcctctcaaccattatcgtatacttgcttaattttctaagggaggatattcttccttaaattttagggaaagaagaatatggcttatattgtagggttaaccggtggtatcggtagcggtaaaagtaccattgcgaatcttttttcagaactaggcgtacctattgtggatgccgatgttgtcgctcgagatgtcgtagcaaaagattccttaatcttagagaaaattattgctcattttggtgaagaagtgcggttggaaaatggtgagttaaaccgatctgaattgcgtaaattggtatttcaaaatgaaaaagaaaaattatggctaaataatttgttgcatccggtaattagagaaaaaatgttgcaacaattatgctctgttaattatccttatgtgctttgggtcgttcctttactcattgagaataagctaatgaaattatgcgatagagtactggtaattgatgtagagcctgaactccagattttacgagcaagccggcgggatagtaattcggttgaattgattaaacaaatgatacagtcgcaagtaaatcgtgagttgcgtttaagttttgctgatgatgtcattgaaaataatctaccccttgaaaaaaacgtggctaatttaaaacaaagcgtagcaaaattgcaccgcacttatttgcattatgcgaagataatttctagaaatagtgaagaatttgaggatataaaatgattgatgaaaaatttactgtagcctgtcccaattgcaaaaaagaagtactttggtcagaggaaaatcgatttcgtccattctgtagcaaacgttgtcaattaatcgacttaggtgaatgggctacagaagaaaagattattcccggttcagaaataaccttgttaccgaacgatgaatttaaagaaaattgagagttatgaatggatagataaataaatagataaaaagaatattgagattttaatttgggcttgttagaatcagcccacttttattttgataaataaaaatatagttcgaatgaaggtagctggagaatggggaattgaccccaaaccgacgaggtaaaatctttcaggtgcgatggcgaggactgttactggacgaacccttggagagatccaatgtgcaatgcacaaaatggacgccgaaggcgcaaaagagcggtgttttttactgcttttcaaacgctcaggcaaaaggacaggggcaaaagattcttttcggatagaaacgttgcatagcgttttttctttattatcccaaaaacttttcgcctccttgtaaacacacgttattttacgaggaatacttatgtcattagagataattttatcgtctatcaatacttttgtttggggacctcccttacttcttcttttatttggtacaggtctttacttgaccttacgcttaggatttattcaaattcgttacttacctcgtgcattatattatttatttgataaagaacgtcatgtaagtaaaaaaggggatatttctgctttcgcagccctttgtacggctttagcggcaacaataggtacgggaaatattgttggtgttgcaactgctttgcaagccggtgggccaggggctattttttggatgtggttagttgctttacttggaatggcaactaaatatgctgagtgtttattagcggtgaaatatcgggtgcgagataaacaaggttttatgagtggcggaccaatgtattatattgagaaaggcttaggaataaaatggcttgccaaattttttgccgtctgtggtgtattagttgcatttttgggcattggcacttttcctcaaattaatgcaatcacgcatgctatgcaagatacctttaacgtatctattgaaattacagcaaccattattaccgcacttattgcacttattatcttaggcggtgttaaacgcatttcaacagttgcatctattatcgttccttttatggctgttttatatgtacttacgtctttgttaattcttatactaaattggcaacaagtaccaaccgctattggactaattatttacagtgcatttgatcctcaagcagcattaggcggtgtatttggatatactgttctgaaagctattcaatcaggatttgcaaggggtattttctctaatgaatccggattaggtagtgcaccaattgcggcggcagcagctcaaactaaagaacctgttcgtcaaggattaatttcgatgataggtacttttttagatactatcgttgtatgtactatgacaggtatcgtgcttgttttaacaggtgcttggcaatcacaagaattggctggtgccgctttaactaactatgcattttcacaagggttaggaaataatatcggtgcaacaattgtaactgtagggttactgttttttgcttttaccactattttaggttggtgttattacggagaacgttgttttgtttatctggcaggtgtcaaaggtatcaaagtttatcgttcaatttttatacttttagttgcctgtggtgcttttattaaactggaattaatttggattttggctgatattgtgaatggtttaatggcatttccaaatttaattgctttagttggattgcgacatattgtgatcaatgaaactaaagattattttattcgcaggaaacaaatatttgttgagccaaataatgttgctaattgagcaaaaattaaaggggctgacggcccctttaaatttctctacatcagaccatcatatcaacctcaaataaaaataaaagtgattttttataaatatgataagtagatcatactttttcatttttattcctaaaaagtgaaaaaacaccttgaaaactcctgctaagaggactattttgtaactaagaatttttctgagtggaaacgctcatcaataagcaaaagaggtaaaagctatgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttatttgcaagtagcgagtctgatgatatgtacaaagcaattaacgaagttgaagaaaaattagaaagacaattgaataaattacaacataaaggagaagctcgccgagctagtgaaagactaaaagacttgttttgataaatgagtttgtctaaaagtagagtgaaaataaaacgctctatttattgcgtaatgaattttacttattgtatgttacctatttgaacctaccaaataagtagtgtaaatcgtggcttctcgtaagtcctaaaaaagctgatgtttaaacttcagcttttttgttagaatatatcggcgataaattttattaaggaatgaagatgaaaaaacatcatgttgacgttttaattactgaggaagatgtacgttcacgtattcaagaattaggtagagaaattacacaattctatcagcataaacacgtaaataaattggtagttgttggattattacgtggttcatttatgtttatggctgatttagtaagagaaattaaattaccgattgaaattgaatttatgactacttccagttatgggaatgaaatgacaaccaatcatgatgtacgaatagctaaagatttagatggcgatattaaaaatgaagatgtattgattgttgaggatattattgatacaggatataccttagaaaaagtgcgggagattttattgctacgttcgcctaattcattagcaatttgtactctattagataagccgtctcgccgagaggtagacgttcctgttgaatgggttggatttactattcctgatgaatttgttgtcggctatggtattgattatgctcaatgttatcgtaatttaggctatatcggtaaagttactttggaagaataagttaccgaaaaggaaatgtttctatcaaaaattaaacaaaaaaagagattaaaaaatctctttttttacacattctttaagaaagaataactatatagataaaattgaaaataattagaaattatcttcaagcattgttaatttttttctcaaagcgttcagcagcagcatcccaattcaccacattccaaaatgccttgatataatctggacgacgattttggaattttaagtagtaagcatgttcccaaacatccaataccaaaatagggaaaccttcgcaaccggcaatttcttttcccattaatggactatcttggtttgcggtagaaacaacttctaatttgccttgatttaatactagccaagcccaaccggaaccaaagcgagttgcagcggctttctcaaactcagcttggaaactctctactgaaccaaaatcacgctcaatagcgtcttttaatgggccttgtaaagttgtacctgtttttaaacctttccaaaataaactgtgatttacatgcccaccaacattattgcgaatagcagtacgtttatcagcaggaacttcgactaatttggtaattaattgacccggacaaagatctgtaaactcaggtaaagtttctagtgctgcatttgcattattaacgtaagtttgatggtgtttactatgatggagttccatagtttgtgcatcaaagtgcggttctaaagcatcataagcataacctaattcaggtaaagtataagccataacaatttccttctataaaaaattctgaataataaactcggcgaattctagcaaaaaatttgatcaagatcattaaaagtttaatttttttaaaaagccctaccgtaagatagggctataatagattaaaaaacattcaacgattctgtgcttttaccgctgcaacggctaccatattaataatacggcgtactgatgaagcagaagtaagaatatgtgccggtttttccacacccattaaaattggtccaattgtaattggtgttgctgtaccttgtaataaattcaagctaatacgggcagtttccatgttgggcataatcaataagtttgccgcccctttaataggactgtcaggcatcacttccttacgtaaattctccgataaagcaatatcacagtgcatttcaccatcaataatcaagtccggtgctttttcacgcacaagttctaaaacctgccgcattttaaccgcacttgggtcattaattgaaccgtaatttgaatgtgaaacaagtgcaacctgtggctctataccaaaacgacgaacttctttggctgacataatcgtgatttctgcaagttcctcggctgttgggcttgagttcacaaaagtatctgcaataaataaattaccggtaggcaaaaccagtccgtttaccgtagctggaatttcatgttctttttcaccaacaacctctttaacagtagccaagtgtgccgcaaatggtccaactaatccgcaaatcatcgcatcgactttaccaagttccaataaaactgcaccaagtgcggtcggattatggagcatttttcgtttggctccggtaggcgtcataccttggcgttttaatttgttgtaataagtatcacagcattcctcgtagtatgggttattttcaatgtcaataatctcaaaatcacgtccaacctgtaattgcagccctaattttttgatgctttcttcaataatatgagtacgccctaacagaacaggatacgctatgcctaaggttgcaatttcttggattgcatgtaatacacgtttttcttcgccatcagttaaaataactcgctttttatcttctttggcctgtgcaaaaacaggtttcatgaataagttggttttataaacaaactgggttaatttctcaatatatgcctcaaaatcttcaatcggacgagtagcaacaccgctatccattgccgctttagctacggcgggtgctatttttacaattaatcgaggatcaaacggttttggaataatataatccggtccgaaagaaacgccgctctcaccataggcggaactgacaacctcgctttgttctgctaaggctaaatcagcaattgcataaactgccgcaagtttcatttcttcattgatagtcgttgcactgacatctaatgcaccacggaaaatgaacgggaagcataatacattatttacttggttcggatagtcggaacgaccggtacaaacaatcgcatcaggtcgaacagctttggctaacggtggtaaaatttcaggctcaggatttgctaaggctaaaattaaaggattaggccccattgtttttaccatttcttgagtaagtgctccagcggcagaacaacctaagaaaatatctgaatctggaatggcatcagctaaagagcgttgaccgttatcatcaatagcatataactttttggtgtcatccattttttcgtcacgacctttataaatgacccctttagagtcacaaaccgtgatattttcacgtttcatgcctaatgaaaccagtaaatttaagcatgcaatagaagccgcacctgcaccggaagtaactaaacgaacatcttcaatttttttattaacaatacgcaatccgttaattattgcagcggctgaaataatggctgtaccatgctgatcatcgtgaaaaacaggaattttcagacgctcacgtaatttttgttcaatataaaagcattctggtgctttaatatcttcaagatttataccgccgaaagtcggttctaaagcagcgataatttctactaatttatcaggatcttgttcatctacttcaatatcaaagacatcaacaccagcaaacttcttaaataaaacccctttaccctccataacaggcttaccggctaacgctccaatatttcctaaacctaatactgcggttccatttgatatcactgcgactaaattgcctttggaagtatatctataagcagaggcaggatctgcttggatttctaaacaaggtacagccacacctggagaataggctaaggctaaatctcgttgtgttcccaatgattttgttggtgtaacttcaatttttcccggttttggaaactcatgaaaatctaaagcggcttgacgtaattgtgcatccataatttttccttatattaactatttacttcatttcaactttgctaaaaaccaattgcattatagacaaaaaaataggcaaaaaagtaacacaaaaattttatttacataatttaccaaattgtatgatatacagaattaaacacaaaaacaggcatatatttttactatatgcccattgaaactaaagagccattttacttatgtaatgtagctttgtaggttgggttcattaaattctccacagaaagaatattatctaactgctcttctgttaataagcccatttccagtacaacttcacgcactccacgtcctgttttagcacatgttttacctactatatcgccattatgatgaccaataaacggattcaaataagttacgattccgatggaattaaagacataattttcacaaatttctttatttgcagtaattccatcaatacatttatcacgtaaattcacgcaagcattcgttaaaatttcaatactttcaaacatggcttgaccaattaccggttccatcacatttaactgcaattgccccgcttcagctgcaaaagttacggtagtatcattaccaatcactttgaaacaaacttggttgactacctcaggtacaaccgggttgacttttgccggcataattgaagatccagcctgtaactcaggtaaattaatttcatttaaacctgcacgtggacctgatgaaagtaaacgtaaatcattgcatactttagataattttaccgcagtacgttttaacgcaccgtgtaccataacataagcaccacagtctgaagtggcttcaattaagtttggtgcaactgtacaaggtaaacctgaaacctcagataaacgcttaacaactaattctgaataaccttgaggagtatttaagccggtaccgatagctgttgcacccaaatttacttctaacagtaattcagccgtgcgggttaaattacgcacttcttcatctaataatacagaaaatgctttaaattcttgccccacagtcataggaactgcatcttgtaattgagtacgtcccatttttaagatattcgaaaactcttttgctttattttcaaaaccttgttgtaaataaagtactttagttaccagtttcataatactgttataaacagcaatgcggaaacctgtcggataagcatcatttgtagattggctggcattaacatgatccatcggatctaaaatatcatattcccctttcttatgacctaaaatttctaatgctaaattagcgaccacttcgttggtattcatatttacggaagtaccagcaccaccttgatatacatctgaaggaaattgatccatacatttaccatcaattaaaatcgcatcacaagctttcacaatcgcctgagcaattttatccggaattgcacccaattctccatttgcaagtgcggttgctttttttaccatgaccataccacgtacaaattcaggtacatcagaaatcgttacattagaaatgttaaaattttctaccgctcttaatgtatgaatgccccaatacgcatcagctggaacgtcacgttcaccaagcaaatcaatttcttttctcgttatcatatttctttcctttttaatttttcagactaaagaatgtaagtcattataggatagatagtcgtttaaaaatgtgatcccgatcacttttcagcactcctctcaccaatatattttttataaaattcattagttttttttatggaaaattaaataaaaaatacccttgaaagaaccaaaatatcccccatatagggtgagctttaattttttattaattattaataaggaacccaaacaatgaatattcgtccattacatgatcgtgtcatcattaaacgtgaagaagtagaaactcgctctgcgggtggtattgtcttaaccggctcagctgcaacaaaatccactcgagcaaaagtattagctgtgggtaaaggtcgtattttggaaaatggtacagttcaacctcttgatgtaaaaattggtgatactgtgattttcaatgatggatacggcgtaaaagcagaaaaaattgatggtgaagaagtgttaatcatttctgaaaatgatattttggcaatcgtagaataaaaacaaattaaattaataggaatacagaaaatgacagcaaaagacgtaaaatttggtaatgatgctcgtgtaaaaatgctagcaggtgtgaatgttttagcagatgcagtaaaagttactttaggacctaaaggtcgcaacgtaattttagacaaggcttttggtgcacctactattactaaagacggtgtgtctgtggctcgtgaaatcgaattggaagataaatttgaaaatatgggtgcacaaatggtgaaagaggttgcctctaaagcaaatgatgctgcaggcgatggtacaaccacagcaacagttttggctcaagcgattgtcagcgaaggtctaaaagcagtagctgccggaatgaatccgatggatttaaaacgtggaattgataaagcagttaatgcagtggttgaagagctaaaaattctttctaaaccttgtgaaacgtcaaaagaaattgaacaggttggtacaatttccgcaaacgccgatgaaactgtcggtaaacttattgctcaagcaatggaaaaagtcggtaaagagggggttattaccgttgaggacggttccggtctttcagatgaattggatgttgttgagggtatgcaatttgaccgcggttatttatcaccatacttcattaataaaccggaagccgcaactgttgaattagataatccgtttattcttcttgttgataaaaagatctctaatattcgtgaattattaccggtcctagaaggtgtagcgaaagctggtaaaccattgttaattatcgcagaagatgtggaaggcgaagcacttgcaacgttggttgttaacacgatgcgtggtattgttaaagttgctgcggttaaagccccgggatttggagatcgtcgtaaagcgatgttacaggatattgctatcttaactgcaggtactgtcatttcagaagaaatcggaatggagcttgaaaaagcaactcttgaagatttaggtcaagcaaaacgtgtggtgatcaacaaagataacacgactattattgacggtattggtgatgaagctcaaatcaaaggtcgagttgctcaaattcgtcaacaaattgaagaagcaacctccgattatgataaagaaaaactacaagagcgtgttgcaaaattagccggcggtgttgctgtaattaaggttggtgcggcaactgaagttgaaatgaaagagaaaaaagatcgtgttgatgatgcgttacatgcaacgcgtgcagctgttgaagaagggattgttgccggtggtggtgttgcattaatccgtgctgcaacaaaagttgcaacaacattaaaaggcgataacgaagatcaagatgtaggtatcaaacttgctttacgtgcaatggaagcaccacttcgtcaaatcgtaaccaatgcgggagaagaagcttctgtagttgcaagtgcggttaaaaatggtgaaggaaacttcggttataatgctggtacggagcagtatggtgatatgatcgcaatgggaattttagatccgactaaagtaactcgttccgcactacaatttgctgcatctatcgcaggattaatggttacaactgaatgtatggtagccgatctgccgaaagaggagaaagctgatctgacaggcggaatgggtggtatgggcggaatgggcggtatgatgtaattctccccatattccatatctaatcattatgttaagaagggtcgtcagaccctttttatttttcaaaaaacgtagaccttaattattagctatctagaagtctagattgttattttgcctattttttattagaatactcaatattactaaggttattaaggatcaacaaaatggcagattgggacggaaaatatattagcccttatgcagaacatggtaaaaagagtgaacaagttaagaaaattaccgtttctattccaattaaagtattagaaattttaactaatgaacgcactcgtcgccaactccgtaatttacgtcatgcaacaaatagtgaattattgtgtgaggcgttcctgcatgcttttaccggtcaacctttgcccacagacgaagatctattaaaagaacgtcatgatgagattcctgaaagtgcaaaacaaattatgagagaattaggaataaatcccgatgactgggaatattaatagattaagtttggtaagttatttcagcaagtgcggtcgttttgaccgctttttcgctttttattagtgaatttcactcgggaatgttacaatccgctaccgttataacaatagagataaatacaatggctcgtacaaaaaaaactcgtcgaataacagatattatgcctatgcgtaaaacagataaacgtccggaaaatctgtcacgtcccggtaaaaaacttactcgttatgaacttgatgctaaatctcgtgaagaaaaaaagaaaaaaaaacgtaaaggactaaccgctggttcacgtcatagtgcagtagatacaagtaaaacaatcgtacttaatgaaaaaaaagatcctcgtgttgggagtcgtaaaaaagttcctcttattgttgaatttgtgaataaacctgaaaaaggtatgtttattccttcaggtgctttagaggaaaaagcgaaaactattgatccgatgctggaactgacacaactcgaaaataatgaaagtttaaatcaattattagatgagcttgatgcaggtaaaaccttaagtaaaaaagatcaaatctttgtcaatcaatgcctagaccgtattgctcaacttatggctgaacttggaattgaagaagaaagtgaagatgatttgtaccgcacttttgagactattgatattaaccaatttaaataagctatgtggatcacaattttaatcattctcggcggattaattattagcgttatgcttggttacgcaatatatttattgctcgttttacaaaagcagaagaaagttttgttgcaagcaaaacaggctagactaaagcgtttaaaagaaagttgtgaaattatcgctaatgcaatgcaaagtggagaatgcaatttatctgaaggtgttatccgtctaaaaatgttgcttgaaccgttagggcattcattgaaaaattacacttcaatgtaccaactctatgaagcagtaatggatatgccgacccatgatgctcggcgaacattaaagaaaaatgaacgtatgcgtttagatttacaacgtgaacgtgctgaagctgatttagaacaaaatatcaaacttgaaattcagcgactattaaattacctaaaagaatctaaggaaaaataaatgtcagaaattatctgggatttagcattaatccaaaagtataaccattcaggtccaagatatacctcctatccaaccgcacttgaattcaatgaaagctatactgataaagattttcagcaagctgctactcgttatcctacacgtccgctttctttatatgtacatattccattttgtcataaactttgttatttctgtgcttgtaacaaaactattactcgtcatcaacataaagtagagatttatcttgattatttagaaaaagaaattcaaacaagggctccgttatttcgtcatcgcatcgcaactcaaattcactggggaggcggtacaccgacttatctttcagaacaacaatctgcacgtttaatgcaaatgctgaaagagaattttactatttcagataaggcggaaatcagtatagaaatggatcctagagaaattgagctttctatgctggatcatttatacaaaattggttttaatcgtattagtatgggggtgcaagattttaataaagatgtgcaaaaagcagtgaatcgtgaacaagatgaagaatttgtgcgtgaattgttgattcgtgctcgtgagttaggttttcgctcaaccaatctcgatcttatttatgggttaccgtttcaaaccgtagaaagttttatgtttaccctacataaagttatcgaactcaatccggatcgtttgagtgtatttaactatgctcacttaccaagccgtttcgccgggcaagcgaaaattaaggataaagacttaccaacacctgaaacaaaactaacaatcttgcaaaaaactatcgaaacgttaggacaagcaaactatcgttttatcggcatggatcattttgctaaaccggatgatgaattggcaattgcacaacaaaaaggaattctacaccgcaatttccaaggttataccacgcaagaagaatgtgatttattaggtttaggtgtttctgccattagtttattgggcgatacctatgctcaaaaccaaaaagatctcaaacaatactatacccacgtagaagaaactggtttagcattacacaaaggtttggtgatgacgcaagaagactgcctacgccgtgatgtgatcaaacaattaatttgcaattttaaattagattttcaaccgatagaacaacaataccaaattgattttaaaacccattttgctgaagatttagctttgctccaacccttagcaactgacggcttagttgatattaatgacaatgcgttacaagtatctgctaaaggtcgtttgctcattagaaacatttgcttgtgttttgatacatactctagacaacaagcaaaaagacaacaattttctcgaattatttaacgaaaaagtgcggtcaaaattaaccgcacttttttaacctcgctgtgcatttttcataatgcgatctttcgttactttccattcacgatctttaatatcttcacgcttatcatgtaattttttcccttttgctaaacctattttcacctttgcccaaggacctttccaatataatgaaagtgcaacaatagtgaaaccatctcgatttgctttaccaaataatgaagccaactctttctggtttaataaaagtttacgtgttcttgtgggatcgcaaacaatatgcgttgaagcaacacttaacggctgaatggttgcaccaaataaatatgcctcgccatgcttaaaaataatataactatcgccaatactcgctttacctgcacgcatcgatttaacttcccagccttgcaaagaaagaccggcttcgatttcatcttcaataaaataatcgtgtcttgctcgtttatttaaggcaatcgtattagatgctacctttgcttttttctttgtcatataaattcatatctcattaaaagtttttcgcattttacccaatctaagcaaagatcgcaaaaaggcttgcattacatcgcattctctataacaatgcggatattcttgataacccgttacgcaaaatatgaaatataaaaatctacgagattttcttgaattattagagaaacaaggtgagctcaaaagaattacacaggaaatcgacccttatttagaaatgacagaaattgctgaccgcactttgcgtgccggtggtcccgcattactttttgaaaatccaaaaggctatgaaattcctgtgctttgtaatttatttggtactcccaaacgtgttgctcttggaatggggcaggaagatgttaccgcactgcgtgatgtagggagattactggcttttctaaaagaacctgaacaaccaaaaagttttaaagatttatggtcaagtcttcctcaatttaaacaagtgctaaatatgccaacgaaagttttgagtaaagcagagtgtcagcaaattgtattctctgatgctgaagttgatttatataaattacctattatgcactgttggaaagatgatgttgcacctttagttacatggggattaaccatcactaaaggaccaagtaaaaaaagacaaaatttaggtatttatcgccaacaattaataggaaaaaataaactcattatgcgttggctatctcaccgtggcggtgcgttggattttcaagaatggaaagaagcacgccctaatcaaccctttcctatttcggttgctttaggggcagatcctgccactattctaggtgcggtcacaccagttccggatactttatcggaatatgcttttgccggattattacgtggtaataaaacggaagtggtaaaatcaatcagtaatgatcttgaaatacctgcaagtgcggagattattttggaaggttatattgatccaacggagaccgcacttgaaggtccatacggagatcatacgggttattacaatgaacaagaatattttcctgtatttaccgtgacacatcttaccatgcgtaaagatcctatttatcattcaacttacacaggtcgtccaccggatgagcctgcagttttgggtgaagcactgaacgaggtttttattcctattttgcaaaagcagtttccggaaattgtcgatttctatcttcctccggaaggatgctcttaccgtcttgcagttgttacaataaaaaaacaatatgcaggccacgctaagagagttatgatgggagtatggtcatttttacgccagtttatgtacacaaaatttgtgattgtctgtgatgacgatataaacgcacgagattggaaagatgtgatttgggcaattacaacacgtagcgatcccgcccgagattgtacaattatagaaaatacgcctattgattatcttgattttgcctcaccgattgccggtctcggctcaaaaatgggaatagatgcgacaaacaaatggattggagaaacgcaacgtgaatggggaaccccaattaaaaaagcccccaatgtagttaaacgcattgatgatatttgggagagtctaaatatttttgctcccaaataaacagcaaaaggtaaataagtgcggtgcttatttacctgtttatttcaaacgctcaaatccggctttaagatcggcaataaggtcatcaacgtcctctaaaccaatatgtaggcgaattaatgtaccggttaatttgcgttcaatattaggtctaatcctagcgatttcttccggttgattgcataaaatcagcgattcaaatcccccccacgaatatgccatagtaaaaatcttaaaatgatccataaaattttctaacgcctgttgagaaagttttttatttagttcaaaagaaaataatccactggaacctgtaaaatatcgcttaaaatattgatgtcccggacaacttggcaatgccggatgataaacagtttttacttcaggctgttccagtaaccatttagctactttaattccattttcttgatgctgttttaagcgaactagtagagtacgaataccacgggctgtcatgtaagcggtatcagcatcaaccatctgccccattaaataagaattttcacgtaattgttcccaacaacgtgcattagccaccgctgtaccaatcatcgcatcagaatgcccaatgagatattttgtccctgcttgaattgaaatatcaataccgaaatccaaagccttaaaaaatacacctgcactccaagtattatcgatcataactactattttaggattgatttggcgagcagcttgcacaatcgatacaatgtccggcatctccatagtaagtgaacttggtgcttccaaaaacaagactgtcgtatttggttgaactaaatccgcaattttttcaccaattaaaggatcataaaatgtggttgtaattgacattttctttaaaattatatgacaaaattcttgcgttggttcataagcagcaccgctcattaacacgtgatcaccggtttttacaaaagctaaaatagcattacttaccgccgccgcaccgcaaggatagagatagcaaccctcaccaccttccaattcacacattaattcttgcaaagcaaaatgtgtcaacgttcctcgacgtccataaaataatccaccttttgctcgattgatagttgcttgttttttatctgctaaagtatcaaaaaccaatgaagatgcacgctgaataacagggtttaccgcatttttacatactcgtttattacgccctgcatgaattgttgatgtggtaaaagaagttgtattactcatagaaatatccattttaaacaaaaatcaagattataataattgatttaatagtcaaaaactaatacaaaagtgcggtcttttttcataaaataattgtgcgaatttgctttagaatgcaaaattcttaataacttttataggagatttttactatggtattagttactcgtcaagccccagattttaccgcagcggcagttttaggcaatggtgaaattgttgaaaaatttaatctaaaacagcatattgctgggaaagcggcagttgtttttttctatccaatggattttacttttgtatgcccatctgaattaattgcatttgatcatcgttataaagaattccaagatcgtaatgtggaaattattggtgtttcaattgattctgaatttacacacaatgcatggcgtaacacaccggtagataacggcggtatcggtcaagtacaatatgctttagtggcagatattaagcacgacatcgcaaaagcttatggcattgaacatcctgaggcaggtgttgcattacgtgcatcattcttaattgataaagaaggtgttgttcgtcaccaagtcgtaaatgatcttccattaggtcgtaatattgatgaaatgttacgtatggttgatgccttacaattccatgaagagcatggtgaagtatgtccggcacaatgggaaaaaggcaaagaaggtatgaccggtagcccagaaggtgttgcaaaatacttaaaacaaaatgcagataaactttgatctcatcaattttaactaaaactagccccgcacttatgtggggctatttcattataaatctagtcattcttataagatcctctgaaaaataggaataacattattagcaataattttccatgaggatatacaaaaaagctcccaaaataaattttaggagcttcaatttttatttcataaataattagcgacgtaagcctaaacgtgcaattatttctgagtatttagcaagatctgtacgttttagatagtctaaaagtttacgacgacgagagaccatgcgtaataaaccacgacgaccgtgatgatcttttttatgtgtagaaaaatgagcttgcaaatggttaatttgtgcagtcaataatgcaatttgtacttctgaagaaccggtatctttcgcatcacgaccaaattcagcaacaatagctgcttttttttctgtacttagagacataaacattccttatactaaaagggttgataatacatcattcgccgatctctaactcagcgatgacaggaactgcagattttatctctcgattataaaaaaagcaataaataattactcaacatacaaactagacctacttacaatgttaccgcattatttatgcgtattatgcgtaaaaactaaaaatgaaggatatatttttcttgattttatagcaagaaagataaagaatattaactaataggattataattaagtaagatatttaattttagataagtggcataagtggctaaaaatgttccacataaagtaggataaaaattttctcaatctattcaatcaaatttttggagatttatattatgacaatacaaccagatccaacttctgtaaaaacgcactttcaaggcaatgacaaactattgtttggtatgattatgggagtgattgccttttggctttttgcacaaaccacgttaaatattgcacccgatatggagcaagatttaggtgttaacaccagtattatgaatattgctgtatcaattacagctttattttcggggatgtttattgtcgttatgggcggtcttgcagatcgtatcggctgtttaaaaattttaaatttaggttttttattgagtattattggggcattgttaattgcactggctccatctggtgatttagctgtcccactattaatgttagggcgtattattcaagggatatctgctgcttgcattatgccatctagtttagctttagtaaaagcctattgggagggcgaagctcgtcagcgtgctattagtatgtggtctatcggctcttggggtggttctggtttatgtgcactcttcggtgggttagtatctcaaaatctaggttggcgttatattttctttgcttgtgccactttatctttattaggttatgttatgtgtcgtggtaccccagaattcaaaatggaagatgatggaaaaaaacataaatttgactggggaggtgttgttacctttatgattgccatgatcgctttacaagtattggtgactcaaggtggtgatttcggctggacaagcatgaccactatcggtttattgctagtgacttttgtgtcaatcgtattatttttatggattgaggagcgtgctgataaagcgtttgtggacttttcactttttaaaaatgcgacttacaccggagcgactatttctaacttcttgctcaacggtgtagccggcatgttaattgtatcgttacaattagtacaattgggcggtaatatgactgcacaatctgccggattgcttactattggctatgcgattgcgattattgcttttattcgtgtgggggagaaattattacaacgttttggtgcccgtacacctatgatttggggctgcctaattacaggcttttctattgctttgttattaccaacgaatatgatgttggagcaatataagattatcgttgttatttcttatatcttgtttggtataggtttagcattttatgcaaccccatccactgatgccgcattatcaaatcttccgcctgaacaagcgggggcgggttccggtctctataaaatggcttcttcactgggtgcggcatttggtgttgctatttcagcggcaatcttcaccgcactccgtgcagagaatgccagtgtatcttggttaaataacatcgtcccttttgttggtcgccaagataatattgctattcgtgaagctgctactattgcattaatgtttaacttattgatgatttttggggctattgtgtctattatgttgactgtgccaacgggcaaaaaatcatcctaaccacagtatttacttgatattcaggctacctaaatcattccggtagtctgaaaccctaaaaaacagggttcagtaaagaaaaaatcatgactatattatttacaaactatcaccccaagcaaatcggaaaaatcaacgtatattttcgttatatctaccagccactatatatttagtcaaaaaaatctacgtctaaatttattggcggtttagtccaatttttgggtatagatcattttgaccgttctttttattttttgcataatagccactttatttttatccgtctcttacgtatggagcattctatgctgacagaacaatctaaaaaacatatcgcacttttgtcttttttacctgtattactcttaattgctattgatttctttaccatgagtttacaagctcaagcaaaagcaatttcccacttgagtttagctgtattagttacacaattattatgtattttagtgtttgccaaaggtgaaatttgcaatggtcaacgtttcagattagtaaaggtaaacttatattttttgatttattgggggttatggctgtttatcagtgtattttccaattatcactatgtattaactgatattgtatgtttgtgtggcattgctttaactttggctatttggcaacaacctcaagatttgcaaatgcgtaagtcattgttggttttaggaacacttgtgggagttttaggtatagtaacttattgtttaatgtttattgatttacctttactttatttttctcaatataatccagtagctcaagcattgctaggcatcatattagcgaatttattgctagtcatcgctaaaaaccgtttacaaggctttattatcttattgccttttttgatgctgattactttattactgaatgcaattattgtgttaggtattttgttttttgctatatcacaacaagttgtattttctaatgagttttcttggggactttattttattttacatttagttattacctgcattattgctatacatttattttataaatggaagtttgaatattacgttctgttaataatgagttttattgtgatgagttttcctttatgggtaagttttgcctatgtgttttaactaaaataactgcctactttttggaaatgattgatcattgatgagtatgtatgttatcagataagagaaaagcggacaaaatgttttattttgtccgctttgtgtaatattgagaggactaaatgttaagtacagcaattaaagctaaaatagagtaaagtactgataatccgtagaaaataatcccacctgctggaatatgaagtttaaaatcatgtgtgccatggtgaattcgatgcattgccccccaagttggaaaaactaatacaactaatagaatcagtttacctaaccaagaaccggcaaaagcaataatattgtctgcaccgttttcgattaatccaaaaggtagtaatagacctaggataaaaatcaatatagggaagacaattgcacttactgtagtacctgcaccgaacaataaccatacaacaggttcattagagcgttttggagtttctttcatcttggtctccctatttcaagtaaattagcactaaagcaagaatacttactacggctgtaacagcccacataccgatagtaataacattcggatttagtttttcatttttgtacacgatatttagcacttttggcgtcatgaagaaatacgtaactgtattcaaaatggctgctgccaaggcgataatattcagaataataacaattggattttgtaagaaaggaataaaatccgattgtaatccatctttttgacctaggcagatcacgccataaagtaataccaagctaaaccataatgatggaattgctgttgcttcacgcataatgtaaagtttgtaaaaatctagctttttccaccaagttgcttttacttcccgcacatatcttctgcgtttacttgttactgttgtcattttacactccttacttttgcggttttaacattgcaatgacgaaatcttttgcactttcgactttaccttggttgacaccagaagcaggatctacatgtttagggcaaacttcggaacaataacccacaaaagtacaactccatacgccatttttaccgttaataattttcatccgttctgcttttccgtgatcacgattatcaagattataacggtgagcaagagttaagactgccggaccgacaaattcgggatttaagccaaattgcggacaagcggcgtaacataatccacagttaatacacatagagaattgacgatatttctctaattgagccggcgtttgtttagtacgactttccgccaattccgctgacgtatgtggtttaccatctaattcaggtgctttattgcctataatatatggtttgatactctccaaactttcaatgaagtgactaaggtcgaccactaaatcccgttcaatcgggaagtttgctaatggttcaatacgcatatgaccactataatcacgtaaaaaagttttgcaggcaagtttaggtttaccgttcaccatcattccgcaagaaccgcagattgccatacggcaagaccatcgataagaaagttccggttctaatttatccttaatataacctaaagcatctagtaaagatgtttggctgtcataaggaacttggtaagtacgtaagtatggctctttatccgcctcaggattataacgcaatacttcaatattcattattgcttgattagccatttgcttgctccttagcttttgcagccgcttcttgtgcttcagcttccgcaccgtaaacacgttttgctggttgagatttggtgattttcacatcgctgtattcaatccgtggggcaccatcagcattataatatgctaaagtgtgttttagataattcacatcatcacgctcagtatagtctaaacgttggtgagctccacgagattctttacgttcaatcgcagaattagcaatagattgagcaacatcgagaatataacctaattcaacggtatagagaacgttggtgttaaatacgcttgaacggtctgcaatacggatatgtttataacgctcttttaattctgcgattttatccacgggttgttgcatactttcttgtgtacgataaatgccgcaaccttcttccatcgaatcgcccatttcatcacgaatttgcgaccaagattctgttccttcttgattgtataactcttctaaacgatggataacatcttgagcttgagcatcgaccgcacttcggttagcaggttgtgcttcaattgcacgctgtgctgcatattcacctgcaacacgtcctagcaccactaattctgctaatgaatttgaacctaaacggtttgcaccatgtaaaccagaagacgcacattccccaacggcaaataaacctttaatacgggtttcgctattgaagtccacttcaataccacccatggtgtagtgtacgacaggacgaacgggaattggtgctttagcaggatcaacaccttcgtaagcattggctaattcacagataaacggtagtcgttcatgtaaatatttttcccctaaatggcgaagatcaaggtgaacaacatcgacaccttttgctgtttttaacgtattgcctttacgccattcttgccagaaggcttgggaaactttatcacgaggacccaattccatgtatttattttccggttttccgataggtgtttccggtccgagaccataatcttgtaaatagcgatagccatctttattcaccaaaataccgccttccccacggcaaccttcagtcattaagatacctgtattcggtaagcctgtcggatgatattgaacaaattccatatcacgtaacggcacaccatgacgatatgccatcgataagccatctcccgtaacaatccccccgtttgtgttgaaacggaatgcacgacaaccgccccccgttgcaataatgaccgcattagcattgatttgtactagagtaccttccatcatattcatcgcaaccataccacgagcatgaccgtcatcaactaaaatatctaatacgaaatgttcatcaaaacgctgaatttgtgggtactgaatggaagtttggaagagagtgtgtaacaaatggaaaccggttttatcagcagcaaaccaagtacgttcaattttcataccgccgaaacgacgaacgtttacatcaccatcaacttttctgctccaaggacagccccaacgttctaattgagtcatttctaccggagagtgttgaacaaaatattccaccacatcctgttcacacaaccagtcaccaccggcaacagtgtcatggaagtgtttatcgtaagagtcctcatccttaattactgcagctgccccaccttctgcagcaacagtatggctacgcatcggatatacttttgaaactaaagcgatctttaaattaggatttgcttccgctgctgcaattgccgaacgtaaaccaccaccaccggcaccaacaattgcgatatcgacattaactgtttgcacgatattcctccaataatagataagagtaaaaattaatccctaacgggaaattacaaaagcaatactattctgccactattttaaaagagatataactcttttttgttaatttaagctagaaaattttaatttcgtgatctaactcaaaactatatttgaaatagataagaaatattctcattagtttaaaattagatgataagcaatatcatttattaacaaaaacatagcgttactattataaaaattgatttgtcgcattattatttttttcaggtagaatatttcaaaaaatttataaaggattttattatgtctttgaatgaacaatggcaacctagtgcctcgatccaaaatttattggcaagagcaaaaattattgcggatattcgtcgtttttttacagagcggggattgttggaagtggaaactcccgtattgagtgaatttggcgtaacagatgttcatctttcgactttcagcacagcctttacatctccgtttatggaaaagtcaaaaactttgtggctaacgacaagccctgaatatcatatgaaacgtttattggcagctggaagcggtgcaattttccaattgtgtaaagtatttcgcaatgaagaaagcggcaaaaagcataatccagaatttacaatgcttgagtggtatcgaccgcactttgatatgcatcgtttaattaatgaggttgatgatttgttacaacaaactcttgattgtgaaccggctgagatggcgagttatcaatttgtatttcaggaacatgtaggtatagatccgttgtctgcaccgattaatgaattgattgaaaaagcaagagaatgccatttggacggtgctgaaaatgaggatcgcgatacgttgttacaatttttatttagcacgcttgtcgaacctaatattggccaaaataaacctattgcagtttatcattttccggcaactcaggcggcccttgcgcaaattagttcagaagaccatcgtgttgcggaacggtttgagttttattataagggaattgaattggctaacggttttaatgaattgactgatgcacaagagcaagaacatcgctttaatcaagataatcgcttaagagaacaattggggttaccacaacatgagattgatcatcgttttttaggtgcattacaagcggggttgccaaatacagcaggggtggcattgggagttgatagactcattatgcttgctttaggtgctgaaaatatcagcgaggtgatttcgtttaatatagattgtgcttagaataaagtttttgtattacattgcgaaaaagaatttttacaaataacggtaaattattctttcaaactaatttgatgtgaacccaaagattgtttacgattaatcattgcatgaactactaattgtgcagttttaatagcatgataaatttcaatactgtgaatctttttgagatcaataggacaatttttttccaaatgttgtagttgtgtaattaaacattgcaaattttttttagttctatacacattggcaaattgattcattaatgatcttacttgtcgcaatatttcacttgatgagtgagcggattttttctcttgattggctaaatgttgtaaatagcgtattccctttaacacataatgttctttattttgtgtagaaaagtgcggtacattttccacaactttttgtatcgctcttttggcaaacacgaggctaccgcctacagagttccctcctagacgatttgctccttcaatacatgcagaaacttcccctaccgcaaataacccctgtactgctgtttgggcgtattcattgatttcaattccaccgttgcaactatgagcaaaaggtcgaattattacctgatctcgtaataaatgaatatccatttctttttccagccaagttaaatagacttgataaaattccgttttatcatggtaaagttcgggagaataatgtagatacactcctttctcagtaggattttcaatcaaatatttcattattacgagatcaaattcaacactttgaaaatccacactaaaaggtgcatagctactacgttgttgtatcatttgctgaaattgttgcggtgataaatgagaaaataaattcttacctttgctatcagtaacttttatcagatattttaaagtatgctcaccgaacaatactttatacttaggtttaacaaaagcaggaatgaattgaataaattcaagattggttaattttgcacctgcttgataagctacatagtgggtcgaacctattatatctgcaggatagagattgtcttgatacaaccccgcaataccgcctgtggctaatatgatattattcgtgtagcaaaaaatatagcgaatctcaccgcccttttgttgagcaaaaatagcacctttaatttgattttgttcagtaacaatatgtaataaaacagagttttcataaaattctatttggtgctgaattaaaatttgtttagcccgtttagcactttgtttccagttattaattaaatagatcgggcgagtatagtatgcaaagcaagcagggcggttatcttgtcgtagccaaggagtaaatccaattttactcaatagctcaatagcttgtggtgattcttccacataagccctaacaatcttaggattatttactccacaagcgactctctcaatttcttgttgaaagagaattttgtcatcggaatcccctgttatttgaataccaagtgtcgcttttagcggaaaaaaacttgcacctccacctattattgatttgctaattaaaatcggattaagtccttttgcttttgcctcaacacagcatgctaaccctgcaataccagctccaacaatcaataattccgtttcaatttggtggtgaaatttaatatttgtcataatctataaatcttttattaaagataaattcaatgcccacatcacaaaaatatcagcaatatcttctgcttaattaactactacaataatgatggtgctgcattgagcaaaattttggtatattcctgttgtggattatcaaaaacgtccattgcatcaccttgttctacaatcaagcctccattcatcaccacaatacgatcagatacttgacgaacagtttgtaaatcatgagagataaacaccattgcgagatttaactcttttttaagatcggcaagtaaatttaacacttgagcccgtacagacacatcaagggcagaagtaggttcatccgctacgattaactttgggtttaatgccaatgcacgagcaatagcaactcgttgtttttgtccacccgacagtcgtgtaggttcaaccaatgctgcagagcgaggtaatcccactcggaaaagaagttcatacacccgtttttcacgttcatgggggtgcagtacattatggatattcattggatcttttaatatatctattactcgcattcttggattaagtgcggtggcaggatcttgaaaaatcactgaaacttgtcgtccgaattgtttgcgagcctctgcacttccgtatttcatctttaaaccgttaaattttactgtgccggaagagggtttttgtaaaccaatcataacattggcaagcgttgatttaccacaacctgattgtcccactaaacccaaagtttctcctgcctgaatatttaggctaataccatctatagcagtaaattttttcggattaaatattgaaccatcacgggaaggaaattgcaccacaatatcttgtaattcaatgattggttgtttttttaacactttcatactcatgttttaattctccaaatgcgatgcccataaatgtttcggattatcttctgcttgtactaatttcaaatgttgatttggatttgcattaggacgaagagaacgactggcaaatcgatctccttcagcaaaatcaaaaggcgatggtacactgccaggaatttgatacaagcgttccgctctacactcagtagaaagtactgaacccagcaaccctctagtgtattcatgcatcggattcattaataatgaacttgttggagcgacttctactacctgtcctgcatacattactgtaatatgatgagcgatttgtgctactaaggctaaatcatggctaacaaaaaccatagcaaagcccaatttttctcgtaattcattaagtaatttaattacttctgcctgcactgttacatcaagtgcggtagtaggttcatcagcaatcaataatttcggttctctagccaatgccattgcaattaatactcgttgacgttgtccgcccgataattcgtggggatagcgatttaacgttttttcaggctctaatttaacccatcgtaaaagtgtttccgcactttgttttccgccacgctgaatcagttgtgccatttgatctttaattcgcattgatgggtttaacgcacttaaagcatcttgataaatcatagaaatttcgtgaccacgtaaatcatttaatttatctgttttcaataaatcatgttgatttcctgcacgatctgtaaaaagtatttctcctgtaatcttggctgttttaggcaataatcccataatggaaaatgcagaaattgatttaccacagcctgactcgcctaccagccccatagtttcaccttcatgaacagtaaaactaatattatccactagtggaatatcaccataacgatttggaaaacgaatagataaattctttacttgcaaaattggcttcattgctgaattaagttgcattctatcagtacgttccgattctttttgatttaattttaataaataacgtttaagtgctaaactttccgccatagcttcttgtacatcggtagcaagaggctttgatacatcacctttgttatttggattacgtttaagttttggattcacgagagcatcagttagtccttctgacaaaatattaagtgataaaacggtcaacaaaatcattaatccggcaaaggtagtggcccaccaaaagccacttaatactaaatttcgaccttcggataaaacatttccccaagatggataagggggttgtactccggctcctaagaaggaaagagaagcttccaatacaattgcatctgctaccatcactgtagcaaaaaccaaaacaggggcggcagtattgcgaactacatgctttaataaaatatagcttctactgccaccaattactcgctccgctctaatataatcttcttcccactgagaaactacattagctcgtacaacccttgctaactgtggcgtataaactactgcgatagttaaaataataatcggaacagagttaccaaaagtagccagtaataccgcagctaatgcaattcccggaaatgccattaaaatatccattagacgcatgatgacttcattaccaaatttactcgctgtagcagcggttgcacctagtatgctaccaaaaattattgcaaaacctaccgcacctaagccaataaacaatgatgttcttgcaccaaacactaaacgagagaaaatatctcgtcctagacgatctgtgccaaaccaatagtcactacttggtgcttgcaccggtcgtaaggtttgtaatggatcataaggagaaacccaaggtgcaaaaatagcaattaatgcaatcaacatgataaacattaaagcaattttagaggccattgataacgctttgaatcttgctccgccttgagcaagtctttcggctaatccttgacgaaacatcataaactccgaatttttggattgatcacaaggtacaatacatcaacgataatattgaccagtacaaaactaaaggcgattgttagtacaacaccttgtactaaatgcaaatcatgattgacgataccgttaaaaattaattttcccatacctggcaggtcaaaaatttgctcaataactaccgcacctcccagcaaataaccaattcttaaccccaatacagtaacgggggtaatcaacgcatttcgtaatacattatgacgaataacggttgcataaggaacgccattaccaatggctgttcgcacataatctttatccatttcttccaccatcgtagttcgtacaacccgaattagagatgcacacacaggtacagctaaagcgagtgaaggcaaaatcatcgaataaaaataaccgctcggatcttcactaaaagaggtaaatccgccggagggtagccaatccagttccagtgcaaaatattggattaataaaattccaagccaaaaagatggcgttgctactgcggctaccgataataaacgaataacctgatcaatccacgtatcacggtaaagtgcggcaataacgcctaaggtaaaagaaactattgcagcgaggaatacaccaataaaagttagctgtaaagttagtggaaaggctttcgcaatcaaagaagtaatcggttgttcaggtggtgtggtcataccgaaatttaagtgaattaaatttccgataaaacgaaaatattgcacaattacgggatcatttaaaccgtgctgttctcgataaagttgctttgcagcctcacttgcaccttcccctaatgcgacagtggcaggatcacccggtgtaaattgcaagataataaaaaccaaagcactcacacctaatatcattatgggtaatgccgctaaacgacgaagtaataagcgaaagacaatttccattatttttctccaactatacaaaccaagtcagtagaatgaatctgctgtcaataaagataggggctgttaatcataaccacatataaatgaccgcactttctgctcattaaaaacaagcagaaagtgagaaaagttaattatttgcgacctacaccaataaatgaaagtccggtagttggaattggttggaaaccatccagtgatttgttattccaagcggttggtaatttacggtgcaaaattggataaagcggtacttgttcagcaataagattaatagcctgagtccaagccgcttttgcatctgatggctgttttgctttaattgcatcatcaagtaataattgcaatttcgcatattcaggggtatctgaccaaccgaagcgttttttcggccaaacatcaccacgataccaccagctcaataagagatccaaatcgttgctaaatactgatggatcccccggtgccattacgacttcataatttcctttgtctacgtaaccaccatacaatgctccagattgtagatgctgtaaagttactttcacacccggaattttattccaagattctaaaactaaaggggcacattcttttatccaagaatgatctgtagaaagcaattgaaattctaatttattcagacctgcttcttttaaaagtgcggtggctttttcaggattataatcatactgggttgaagccttgacataatcaggatgcgtatcttgagtgtaagaagtggcggcttttgcattacctaagaatacaatatcaattaatttttgtgtatccagtgcatagtgtaaagcttgacgtacttttggattgttaaatggggctttcttacagttaaacattaagaataacaacccgaaagattgcacggattcaaccgcacttttacgttttaagcgagatgcgtctaaataaggaacactttccattgcttgagtacgtccggactcttgtgccgctgtacgagcggcatcatcggatagtaaaaaccatgtcattttttctacacgagcaggatatggaccgttgtaagcattgtgtgcggcaaatacaatgcgatcgtcttttacggctgaaacaaatttatatggtccggatcctaccggatttgcatcaaatgccgtttgtcctacagcctcaatcacatgtttaggtacaatttttacaatacctaatcgcaatttaaaaagagaaaacgggtacttcaacttaaattctaccactttatcatctaaagcgttgactgaatcaataaacggaatgaattgtataaatagtgaagcattttttggatctaaaatacgctgataagaatatactatatcctctgtggtaacaggtgtaccatcgtggaaagtcgcaccgtcacgtaatgtaacacgccatgttatatcatcaacttgttcaggttcttttgcagctaaggcgagataaggttcacgggtggcagggtgtaaatccactaatccttcaaaaaagtgcatgttggcggcaaaggaagaggctccactggaagtggacggatcaaaaccggttgataggggataagctattcctgcttcaatgctactacctgttgttgaagtggccttcgccttagaaacaaaactacctaatgtaccgctaaaggcaattcctgcaccgacaccagccaatactttcatgaaattacggcgagattcattttcaatgtaatttgtcatacatgctccttaaaagtctattttgcacacacttattgagattaatacaacgttccttacacttacacagaatatcattccctaaaatgaagtaaattaatcacaatataaattaaaatgaattggattaatcataatcgtttagagcaaacagtcaagaacatatgtaaagtaaaatctatgtttgtgaactaggtcacgaaataacggaaatctcaatttgattaaagagctaactactatctaaaagcccctgtcagttatagggaaacttgatgaatataaagtggctaattagccactttatatttgcatctgatatttaaacagatgttttaaagatgacattattcgctttctgaatatagctattcatttgatcaaaattcatatagcgataggtatcgtctttatcttgttgcaaattttgaacaaaatctaaatattcagatggagtaggtaatttacctaacaatgcagaaacggctgataattctgccgaggcgagatacacatttgctccttgtcctaaacgatttgggaagtttctagttgatgttgaaactaccgtcgcaccatcggcaacacgagcttggtttcccatacaaagagaacaacccggtacttcaattcttaccccacttttaccataaatgctgtaataaccttcgtcactaagcaacttagcatccattttagtagggggagcaagccatagccttgttggaattgtaccgttaaagcgagctaataatttacctgctgcacggaaatgaccaatattcgtcatgcaagaaccgatgaatacttcatcaattttgtcgccctgaacttcagaaagtaaacgagcatcatcaggatcattcggggcacataaaataggctccttgatttcattgagatcaatttcaataacagccgcatattcggcatctttatccgcctctaatagttgaggattcattaaccaattttccattgctcgaatacggcgttcaagggtacggacgtcaccatagccttcggcaatcatatatttaagtagaacaatattagattgtaaatattcgataataggttctttagcaagtttaatcgtacaagcggctgcggagcgttcagcggaggcatcggacagttcaaatgcctgctctacctttaattgctccaagccttcgatttctaaaatacgacctgaaaaaatattcttcttaccttttttttctacggtaagcaatccttgtttaatcgcataataaggaatggcatgaaccaagtctcgtaatgtaatccctgcttgcatttcacctttaaaacgcactaaaacactttcaggcatatctaaaggcattacccctgtggctgctgcaaaagcgaccagtccggaacctgccgggaaagagataccgattggaaaacgggtatgagaatctccgccggttcctactgtgtcaggtaataacatacgatttaaccatgaatggataacgccatcacctggacgtaaagatacgcctcctcgattcataataaaatcgggtaaggtatgatgagtaaccacatcaacaggttttggataggcggcagtatgacagaaagattgcatcactaaatcagctgaaaaacctaagcaagctagatccttaagttcatctctggtcattggacctgtagtatcctgtgagccaacggaagtcattcgaggttcacaatattgtccgggacgaataccctctacaccgcaagctcgccccaccattttttgtgccaaagtgaaacctttttgattttgcaccgcactttgtggtttggcaaaaacatcgctttcaggcaatcctaatgcaactcttgctttgtgagttaagcctcgcccgataatcaatggaatacgtccaccggcacgaacttcgtctaataacacattagtttttaagctaaattcagctaaaatatcattactgtcatgacgacaaattttgccttcataaggataaacatcgatgacatcgcccatatttaaacggctgacatctacttcaattggcaatgatccggcatcttctagcgtattaaagaaaataggtgcaatttttccccctaacaccacaccgccggcacgtttattcggaatataaggaatatcttcccccataaaccataaaactgagttagtcgcagatttacgtgaagacccagttcccacaacatcgcctacataaaccaacggaaagcctttttgtttcagtgtttctaattgtttgattggaccaatattaccattatcatccggtttaatgccttctcgggcattttttaacatagcaagagcatgtaatggaatatcaggacgagaccaagcgtcttgtgctggcgaaagatcatcagtattagtttcaccgctcaccttaaatacggttaaggttaatttttctgcaagttgagggcgagataaaaaccattcagcattagcccaagattgcaaaatctgttgtgcaaaaacgttaccgttttctgctcgttgtgcgacatcatgaaaattatcaaacatcagcaaagtagaagacaacgctttcactgctataggtgctaattcaggattatcaagtgcggtcaataatggctcaatattgtaaccaccttgcatagttcccaaaatttctactgctttgcttggtgaaattagtttacaagttaccgcactttgtgccagtgcggctaaaaaaccggctttaacataagcagcttcatcaacaccggcaggaatacgattctcaaataaatcaagtaggaaatcttcttttcctatcgggggatttttcaataattcaattaattgagctgtttgctctgcatctaaaggtttagggacgacgccttgtttagctcgttcatcgacatgtttttggtaagtttgtagaaaatcgcacattattcactccattaagattgttgagtagagaaaagagaaagtgcggtcatttttgttaaaaaattgtaatacaaatagaccgaattcatcataatacggaatttatagatgaacaatagaaaaaagacgattattaaaaaataaccgccttttttaaagtagaacacaaaatgtttaaaagacttttttaaatggtttaatgatgactttatcatatacaccggctgcaacataaggatctgtatttgcccattgctccgcttcttctaagctattgaattttgcaataacagttgaaccggtaaaacctgcttctccaggattttcatcatctatagcaggattaggtcccgcagttaataacctatcttcagcttgtaattgttttaaacgttcaaggtgttgttctctgacggataagcgtaatgctaatgtatcaggtttatcttgagcaaaaataacatagtacatcatggtttatttctcctatttattatgagttatttgctgaaatttgtgccaatgctttttctacttccggattattgtctcttggtatggctcgaggtttaccttgtgcatctacggcaacaaaagtgaaaacagcttccgttacacaatagcgttcaccaataggttcgctggcaacctttttgacccatacttcaattttgatttgaacggaagagcggccaatttttacacattccccataacagcaaaccacatcgccgacagcaataggtttgataaatgtcatactgtttacagctactgttacaacacgtccatgagcaatttctttagctaaaatggcaccgcctatatccatttttgacataatccaaccgccgaaaatatcgccattcgcattcgtatttgaaggcatagctaaggtacgtaataagagaactcccttcgattgacgacctgtattagtttcaataaatactgacatagattttccttattcttgttctgatttaggtaaataacgataaatataaacaccggttactaatgttgcaatcagtgtcatgccgagaatgccgaaggttttaaaatcaacccagatgtcatcagaaagatactggcttatgtaaagattaatcagcatacaaagtaagaaaaagactgcccaacctaaattgaggttatgccaaacataagtgggaagctgaatttctttgcctaataattgttggattaaaggttttttaaaaccatattggctgacaagcaaaatcaaggaaaaaagggcataaacaacggtaactttccattttaaaaattccaattcattaaaataggcacttagagaaccgaaaaaaactaccgcacttcccataataagttgctgtttctcaatttttccatatttaagttttaaaatcatgagttgaattaacgttgcaataatcagcgtaatggcagcggcttgaataccttgtaatttgtaaacagcaaagaataagatcaatgggataaattctaatagttgtttcattattgtcccctttgttgcataaagagagtgtaaaaacggtaagtgaaaattaatagaaatacctctgcaagggaaattattgcagtgattaagatttccataaacagattatgactgagaaatagcgaaagctgtcttaataaaaaaggcaataggcaattgattaaagtatataagaataacaggtgtgtgcgttttactccgcttttccacattgtttttaaactttgactaatggagtgattatgtatgaggtaatggacattgagtaaattaagacgcacaaacacaaatatacctaatgcgagtgcaaataaagaaaagatagaaggtgatttgtgcatgatagctgaaactagaatttcacttgtaccgatacccaaaggaatagctattaatatattgagtaacaaaagccctccgaaacgtttagctgtcgatataacgctttgagacagttgcggttcgatatgttgactgagttggtgaatggttaatattccccaagcagaaataaacattctcaataaacccgatatgaacaggtaatgactgagttgcaaagtttccgtatttgatattgtttctgatagctcaagcgtgtctgtttgtattgactgtttaaaaaataaagcaaatacagaaacaataaataaaagagcggtaaattgtagcgtgattttttgttgattgcgtacaaagttccaacaatcttgaaatatatgagtaaaattaatcattcaaaaatccataaataaaagcaaacgttacgcattatactgtgtttacagccgaaagtataaaaatccttattacagaccttaagcatactaaagaggagatttaaacttttagtaagctgattgtaacgattttaaaaaattttttaacaaaattttataaatttgatctagttcacggaaataatacctcttaagtggtattgtacccgccgattgcataaatcggcaatttttattgtgagcaaatattctaatagatgaggaattttctatgaaaaaaacagcattagtacttagcgtggcggctgcattggtggcaggaagtgcaacagcacatgaagcaggcagttttattgttcggggtggtcctattttagttgtgccgaaaacatcgacaaatgattctggctttccgtttgatgtaaacaaaaatgcccaattggggttgaccggaacctatatgatgacagataacttcggggttgagttattagccgcaacaccgtttcatcataaaattacattagaattacattaggtagtgccttagtaggtaaaacaaaacatttaccgccaagcctatatttacaatattatttcttaaacaaagattctaaagcacgtccttatattggtgccggtgtgaactatactaaattctttggtgaaaaagcgataatggctggtgtttctgatcttaaattaaaagattcttggggagctgcatttaacgcaggggtagatattcaattgtccgataatctttatttaaataccgctgtttggtatgcgaaaattaaaacaaaagcaagttttaaaatgaatggtggtgttcaacaacctcaacaacataaagtcgatgtaacccttgacccaatggtatttttcatcggtttaggttggaaattctaagcagagaaaaatattgttgaaggcatgaccaaaaggtgatgcctttatttttttctcaaaatgaccgcacttttatggaaatagcgtataaagtaaaaattaatgttttctctttacatgattttcgttaaaattcggcattcgtccatttttagttattacaacaataatgatcaagcaagctcaattttatattctttctcaacaacaaggaaaaaacggactttttgcggaagaaagtcttacttgtgatcttgccgcctccgcttggcggttggggaaaaaagtattaatcacttgtgaaacggaagagcaggcattaaaacttgatgaagctttatggcaaagagatcctgatgaatttgtaccgcataatttatccggtgaaatgacttcatacgtaacgccgatagagatttcttggcaagggaaacgtaatacgcaacgacgggatatactgattaatctgcaatctcaattacctgattttattatgagttttaatcagctaattgattttgtgccagttgatgagcagttaaaaattcttgcgagagaacgctataaatcgcttcgttcgcaaggttggcaattacaaacagaaaatatgtaaatttttataaggagtttttttatgaaatctaaaattttggctaccacactcgttggattgctattcggattggttgcttgtgaaaaatcacaagaaagtgtatcaaccgaaaaaatggataacaagcagacggagcaagttgaacaaaaacaactggaaagtgcggtggaaaacagcactgaaacacctgtgcaacatgttcaaactgataagatgtcagaaggaatgaaatcaacaaccgaagaagctagcactgattcagcaataaaccaagaaaaattagctgaaaataaagttaaacaggttgaagctaaaaaagtagcggaaaaaaatgaaaccaaaaaagttattgcgattttagaaaaacaataccaaagccttcattgcaccgatggaaataaaagcgaattttgtgtagaagaagcacaacgcttaaaaagtgaaattgaacgactaaaatctcaattgcgtaaatagaaagatgagtagtcgttagatttaagacatttatgctagataatctcttctctctaggcggtaagttagaaaaataacaagtcgtagaatggctaatttatgcccagcttcacacggtttctatggggaaagagcggttagatttaagaaaaattttgcaaaaatgaatcataaattagtccaaatcgatcagctaaaaaatcagcttacacaatatcgtccgctttttgaatcagaagtacaacgcttacgagaagagtttattattgaaagctcatataattccaatgcgattgaaggcaatacgattaccttacgtgaaaccgtgctgattttaaaagagggaatgacgattgcggaaaagccactgcgagaacatttggatattatcggtttcaaagatgcctttaactatatttatgaattagttgccaataatgaaccgttaagcgagcgaaccattaaagatattcattcgcttgttttaatgaataatgctgaaggtcgaggggtttatcgtaaaattccggtgcgaattttaggggcggaaaatgaaccgacagccccttatttaattgccgaagaaatgcagttgttgattgaaaaatatcaacaaaaactgaccgcacttcacccgatagaagcaattagttggttgcatttagcctttgaaagtattcacccgtttattgacggcaacggacgaacagggcgattactgattaattttgaattattgaaacacggttatttacctgttgatattaaatttactcatcgagcaaactattaccaatgttttgatgatttccataaaaatcagcaagatataagtcgtttggttgaattgattagtcagtatgaagtggctgagttgaacaggtatttggcgattttggaacagaggacataaaatgacaagccgtgaagaattactcaaaaaacaacgtgagctagatattctctttactgcgtggtttgaagaaaagaaaaagcacgaagtgctgacttatcgtcgtgaaaatggagatttaattcagcattatccggacggtacagagaaagtgatcaaatatgctgaaaaaactagcactgctcgtatggcgtaacaagcggttggatttaggcaaaattttgcaatgctttaatcggagggaattgtgatgactaaaccggtaaatgcggaatatatcaaagaaattattgataaaacgaataatcttggctatttggacatccaaggaaaaaccttgcaagaaaaacaagagagttttaaatctttaattcaggaaaaattaaagggatatcacaatgacagtcgaaaagatcattatcaccgaagctaaggttcacgagctttttgttgaaatcagtcaagaattggggtttagtgatgaagatattttacatcattctcaaaacattcttgaattgattgaaatgtggtcagagcaaaaatttgtcgaaatttatcaagaaaatacggatagagtttttggtcgggcaaaagatagtagtcttgcaccaggtgcggttccctattatttaggtatttatcacgccagagtagataaacaaggtgaaaatgatccgttaatcgttttaacatttagatcagaaagagaagataacatcgctgaaattcgctttatggcaacacacgatattttatttggcactgtttccgataaattatttatgcaacgaatgaaagctattcgtcaaagaattgatcttttagtccaaaaagggaattaatttataagggctacacggctacgcatcagcccacacggctcgtgtggggtgacaagcggttaggtttaagaaaaattttgcaaaaaacttctcaaaacagaccgcttgtaaaataacaaggcatttgtctagagaggagtaccatctggaaaataatcaaatatgcagataaaaaataacttaaagtttatggacttctgctcaggtattggcggaggtcgtttagggctagaactaaacggaatggaatgtattgctcacagtgaacttgatcctaaccctgatttaacttatcagctcttttttaatgataaaaataattatggggatttaaccaaaataaatatcaacgatttacctgaatttgatgtaatgcttgcaggtttcccttgccaaactttttcaattgtaggaaaacgcaagggttttgaagatgagcgtgggcagattatttatagcttggtcgatattttagctcttaaacaaattccttattttattttggaaaatgtaaaagggttggttaatcataataaaggagaaaccataaactctattgttaagctgctagaagaaacgggctatgatgtttattatcaggtattagatagtcaattttatggtgtaccacaaatgcgtgagagggtttattttgtgggtattagaaaagatattaaacacaaaccttatcaatttcctgaaatggaagatgccaaacctatttcttattatttaagtgatgaccgtgattatacctttgatgagaacaatgaaactttccagaagtatttgaataataaatataatcaagggcaaaataaccttactgaaattttgcaaacggattataacgtgattgattggcggcaatctgatttccgactttatcctgaaaaaagcccgacattgagaaccggacgacacggtattttatataccaaaaatggtaaattgagaaaattaagtggttatgaagcattactattacagggatttccaaaagaaattgcacaaaaagttatcgagcataaattacctgacagtaaagttttatcccaagctggaaatgcaatgacggtgacggttattcagaaattagcggctcaattattaaaatcgatagaaagcatatagagaggtgaagatggatttagccaacctaggctcacaaactgcaaaaaatggctttaagaatgaaaaagatattgctgatcgttttaatcattggcaatcacattctgaagctcaagactggttaagaataatgggttatgaattagataaaattgaaaaggttaaagctgttgtattaagtggttataaagcagatattaatgttcaagtatttatcttttttaaagaagctgttgatgttcgtaacattcaagtaaaattagttagtaataaacgaggctttaatcaaatagataaacgctggttaaaaaattatcatgagatgtggcaattcccagcagaaatttaccgcttgttacagcatttttgtggagaactacccccggttattgagaacccaaaagataagcgaagaatgtttatcacagaatttagtgaacaagaacaacgtttaattttagattggttcaagcagagtaaaattttagttttaaccgatattattcgtggtcgaggagatttttcagcagaatgggtattagttgcccaaaaaattaacgataacgctcgttggattttgaaaaatattaatgaggttctacaacattatggtagtggcgaaattaagatttctcgacaaggttcaattaaatttggtcgggttactattcaacgtaaaggtggagatcgtggcagacaaacagccaatatgttgcaatttaaaatagatccaaccgaattatttgagatttgatttcaagctgcccccaaatgcaaaaattaacataagagaaaaaccaatgacaaaacaattcacaatggaagatcgtttcaacccttccgccgtagagcaagcactctaccaacactgggaatcgcgaggctattttaaaccgagcgaagatattaatgcaccgagctactgtattgcgattccgccgccgaatgtgaccggttcgctacatatggggcacgctttccagcaaaccttgatggatactttaatccgcttcaaccgtatggagggcaacaacaccctttggcaaacgggaacagatcatgcaggtattgcgactcaaatggtggtggagcgtaaaatcgcagcggaagagggcaaaacccgtcacgattatgggcgtgaagcctttatcaacaaaatctgggattggaaagcctattcgggcggtacgatcagccagcaaatgcgtcgcttaggcaactcgattgactgggatcgtgagcgttttacgatggacgaaggtttgtctaatgcggtgaaagaagtatttgttcgcttacacgaagaaggcttgatttaccgtggtaaacgcttggtgaattgggatccgaaactgcacactgccatttccgatcttgaagtcgaaaacaaagagagcaaaggctcgctttggcacttccgctatccgcttgctaacggtgcgaaaaccgctgagggcttagattatttagtggtggcgaccactcgtcctgaaacaatgttgggcgatacagcggttgcggttcaccccgaagatgagcgttatcaatcgctgattggcaaaacggtcgtgctaccgcttgccaaccgtgaaattccgattatcgctgatgaatatgtggatcgcgaattcggtacaggtgtggtaaaaattacccctgcccacgatttcaacgactatgaagtgggcaaacgtcacggattgccgatggtaaatgtgatgacgctcaatgccgatattcgtgcggaagcagaaattatcggcacagacggcaaaccgcttgccggctacgatgccccaattccagccgactatcaaggcttagagcgttttgtggctcgtaagaaaatcgtggctgattttgaagcgttgggcttgcttgatcaaatcaaaccgcacgacttaaaagtcccctacggtgaccgtggcggtgtgccgattgagccaatgctgaccgatcaatggtatgtgagcgtgaaaccgcttgccgaagtcgccaccaaagcggtggaaaacggcgaaatccaattcgtacctaaacagtatgaaaatctttacttctcttggatgcgtgatattcaagattggtgtatttctcgccaattatggtggggacatcgcattccggcttggtatgatgaacaaggcaacgtttatgttgctcgagatgaggcggaagtgcggtcaaaatacggcttaacttcagacgtagcgttaaaacaggatgaagacgtattagacacttggttctcgtccggattatggacattctcaacacttggctggcctgagcaaaccaaagaactgaaaatgtttcacccgaccgatgtattaatcaccggttttgacatcatcttcttttgggtagcaagaatgattatgttcacgatgcacttcatcaaagatgaaaacggcaaaccgcaagtgccgttcaaaactgtgtatgtaacgggcttaatccgtgatgaacaagggcaaaaaatgtcgaaatcaaaagggaacgtgttagacccgattgatatgattgatggtatcagtcttgaggatttgcttgaaaaacgcaccggcaatatgatgcaaccacaattggcggaaaaaattgctaaagcaactcgtaaagaatttgaacacggcatttctgcacatggaacggatgcgttacgctttaccctggcggcgttagcgagcaatggacgtgatatcaattgggatatgaaacgtttggagggctaccgcaatttctgtaataaattatggaatgctagtcgttatgtattaacccacgaaaaattggatctaagtgagggcgaagcggaatattcgttggcggatcgttggattgagagtcaattcaaccgcactatagacgcatttcgcaccgcacttaagcaataccgtttcgatttagtggcaaatacgatttacgattttacttggaatcagttctgcgattggtatttagagctaaccaagcctgtatttgctcatggtacggatgctcaaaaacgtggtacaagtcgcatgcttctcaatatattagagaaattattgcgtttagcacatccaattattccatttatcacggaagaaatttggcagaaattgaagggtgtaatgaagttatcaggcgataccattatgttacagccatttccgcacgcagaagaaagtaagtttgatccggtagcggaaagccaaatggattggttaaaagaagtgattgtagcagtgcgtaatattcgtgcggaatgtaatatttcaccgagtcatgcgttggaactgttgctgagaaacatttcagaggaaacaaaaatttgtcttgaaaataaccgcactttattacaatctatggcaaaattgtccacgattactttactggacgccaatgaagaaccgccactttcggtcacgaaactggttgaaaataatgaaatttttattccaatggcaggttttattaataaagagcaagaactcacaagattgactaaagaaattgaaaaattgaaaggtgaaattgttcgaattgaaaacaaactcagcaatgaagcctttattaccaaagcaccggagcaagttatcgccaaagagcgggaaaaaatgcaggggtatttggataatatagaaaaacttcaacaacaatatcaggcgattgagacgttgtaagtatttaggtcgatatttgatctcccgccgtcaaatggcggtcgggagatcgatgttaatcgtggtgaaaatctatcttaggttctcccaagaataacggaccgagtggatttttaggcaaattgaagtgattaggatacttcacctctaccaaatataaaccatcaggtttagcagttggtgcggctaaagtgcggtctttttgagttaaaagccaatccatccattcaaccggctgttttccgcttccaatttctaaaagactgccaacaatattgcgtaccatatgatgcacaaaagcgttagcctgaatatccacaataatgtaattggcttggcgaaaaacatggagatgatgaatatttcgccatggtgtattggactggcattgtgcggcacgaaatgaagaaaaatcatgttcccccaataaatattgccctgcttggtgcattaaatgatgatccaatgcaacgtgatgatgagtaactccagtgggaaaaagagcggaacgtagcggatgattataaattaaataacgataacgccttgctgtggcactgaaacgagcatgaaaatcctcactgacgacctttgcccaacgtaccgcaatatcagcaggtaaattggcattaagaccgaatgtccatgctttttcagagcgaatcgctttcgtgtcaaaatgtaccacttgaccggtagcatgaacacccgaatccgttctacccgcacaatatatttgacaaaattcatttgcaacaaaactgaccgcactttccagtttttcctgtacacttgtgacattcgcttgacgttgccaaccgaaataatgtgtaccgttatattcaatacctaatgctattttcatattatgttatctgttaagctgaaacccattttatgatacttgaatatagtcgagcggtatatcacctaaatacgccaatagttcttctgtcataccacgatatgacaacctgaaaggttgttcaaccaataccgctcgagcaatattttccacctcatttccatttaaaagtaaataattcaatgctgtttgtagtggcggtaaagagggattaaatgcggcattttcagcataactgccttgaaaaatctgttgatcttgcaattgcaatgcaatacctgaataggttttggaataaggggcatgagattgattagcagcatcaagtgcggcttgaattaacggatcttccgttatcaaaaataaattatgtgcttttttatcaaatagacgattatctatctgtaaattatggggtccaaaagcatccggcaaatagtgatgtaataaattatcctgactatgtggcaaatgaatgcgtaatgtttccgcactgttaagttcattcataaattggcgacaatgtccacaaggtgtgtaattgacggtaatctccgttattttactttcacgacgcatccaagcatgagaaattgcactttgctccgcatgaacggtttgctgaatgttcgtggtacaaaattcttgattagcaccaaaataaaagttgcctgactctcctttagcaattgcccccacactgaaatgggagattgtgggattagcataacacgcactgacgggtagtaatattaaagccaattctttgtccgtcatatgatatttttcgcaaaaatggtttactgtgaatgcgggtagaaagccctgaaaattctgttcgcctaagatataccacagatcctgagccaaatttctgttttcaatttgatttaaagcctgtttaatccgatcagatatatgttttaatgaatgatgtgtcatcataaatccttgttgaatattgagattgggttgaatgtgccaaacatttaaaataacgtcaagtagatgttttaattgtatcttattatttttggctgaaaaatttctaattataacaagttaaacacttttaatatttcatcaaaaatataattttctgcattgaaatagttactcttttttaaacgacatagcataactcgccataaaattggatctttaatttttacgctgactaaatgaggatcgggataatagtacgctgtagataggggtagaatagtcaaaatatctgaattagattttgcagtgtaatataaaaaatcccaacaggctgattcatagatgatattagggtaaatattatgtcgttcaaatgcttctttcaactgttgataaatcataaacgttttatcaaagatgacaattttctctttatgtaattcctgccaagtcacactttctttttgagcaaaatgatgttccggagagcaaaataccgagagttctgagcgataaatttcgaaagattcaataatcttagatgaaatatgttcaggatagagcaaggttgcaaaattgacattacctagtaatagttcaccttttaatgaatatgcaccttgttcttttacttcaaattcaatttgaggattatttataatcagttccggcaaaattttagaaaaaatcaaagataaaattaaaggtggaataccgatagatattcgccctgtcatttcttgttctttcttatgtagatttttgttcatttgattgtatttcttgagtaattctttagcatcacggtagtagttttctccaacgtaagttaaccctctaatttttccattagctcgtgtaaataatgcaatattttcttgatgctcaaattcattaatcatcatacttaatgccggttgagaaatataaagattttgagatgtccgacttaaattgaagccgttttctacaattccaataaaataacgtaaatgtttgatatccatgatttctccttaaccaattttgtgttcagccgttctataagctgtgtttcttttgtattctttatatgtatctacattctataagattaatttataggtatgtaaaaaaactgtattttgaattattcgaacaaattactacacttacctcaaataaggtaagaatactagattatctagattttataagtatgcttgcttagtttttttgggatgtattgagcgttttactctctcaatgtataacaaaaatttaaccttaaatataaatttattttatctcataggaagatgctatgtctaaatttatttcaattgatgagctcaaatctcatttttttgatggaatgacaatgatgtccggtggtttcatggggtgcggtgctcccgaactgatcattaaagaaatcttagaggcaaacattaaggacattactctaatcagtactgacaccgcaatggtagatactggggtaggtcctttaattgttaatgggagaataaaaaaactatatgcctcacatatcggaacaaattctgaaactggtaagaaaatgatttccggtgaattaaatgttgaactttgtccacaaggtactttagcagagcgtattcgtgcaggcggagcaggattaggcggatttttaacgccgacaggggttggcacagtagtagaaaaaggtaaacagaaaatcactattgatggtgtggaatatttactggaactaccgttaaaagcagatattgcaattattaaagcggatattgccgatgagattggtaacttagtttttttaggtgcagctcgtaattttaatccaatcatggctctcgctgccaacacagtcattgtacaagcaacaaaaatcgtgaaagtaggtgaaatggatccaaatttagtgatgacccccgcagcagtggttgattatattgtaaaagcgtaacggaaggagaaaaaacaatgaatgctaaagaaattattgctcgccgtattgccttagaattaaaagatggtgatgttgttaatcttggtattggtttgccaactatggtagcaaattatatcccaagtgatatttcaatcactctacagtctgaaaatggctttttaggtttgaccgcttttgatcctgaaaatcccgatgaaaatattgtgaatgccggtggtcaactttgctcaatccaagcaggaggtatgttctttgatagtgcttattcatttgctttgattcgtggcggtcacgttgatgcttgtgtactgggcggtttagaggtcgatcaagaggcaaacctagcaaactggatggtgccgggaaaaatggtacctggtatgggaggcgctatggatctagttactggtgctcgtagagtaattataggtatggagcattgtgcaaagacgggaacctcaaaaatactaaaaaaatgcactttgccactaaccgcacgtaataaagttcatctagtcgtgactgagcttgccgtatttgaatttatcaatggacaattaaccttaactgaaatggcggaaggttatgatttggatatgattaaagctaaaactgaagctgaatttgtcgtttcgccaaatctaaaaataatgtcgttggcaggtgcataaggagcttattatgattagccgtatttctcggtttatgacaactatcgttagtaagtatatgccagagccactggttttagcagtgctattgagtatcatcatcttcttttgggcactttggggcacagaacacagtacaggtgcattggttgagatgtggggtaatggtttttggaatttgcttgctttctcaatgcagatggcgatggtggtagtaactggtaatgctcttgcttcagctccacaaattcgtcgatttctttcaactgctgcatctattgcgaaaacaccaactcaaagcattatgcttgttacctttatgagttgtgttgcctgtgcaattaactgggggtttggcttggttgtgggagcaatgtttgcaaaagaagttgcacgccgtattaaaggtgtggactacgccttgctgattgcctgtgcatacattggctttatgacttggggaggtggcttttcaggctcaatgccactccaagcggcaacgccaaataacccaattgcacgttttatcacagatggaaattatgctgatggtattattcctgttactaaaacactattaaccagctataacatattcattattggtatgttaatcattacgttaccgtttctcactaaaatgatgcacccaaaagcagaaaatgtaaaaataattgatcctcgcttattacaagaagatccaaaattcagcaaaaagttaacagaatcttccactattgctgagaaaattgaagagagttgcattctggcttacattattgcagggacaggttttgcttatcttgcaatatattttgcgaaaaacggcttcaatttaacgatcaacaccgtaaatcttatctttttaatggctggtttagccttgcatggctcaccagctgcttatgttcgtgctattacccatgcagcacacagtacagcaggaatattaattcaatttccgttctatgctggtatgcagttaatgatggagcattccggtttaggtggcatgattacagaattttttgtaaatatttcaacgaaagacacctttccggtattaacctttttcagttcagcattagtgaattttgcagtaccgtctggcggtggtcactgggtagtgcaaggtccatttattattcccgcagcacaagaactgggtgcagatttaggcaaatcagtcatgggtattgcgtatggtgatatgtgggcgaatatggcacagccattttgggcattgcctgctttaggtatagcaggacttggtgtgcgtgacattatgggctactgcatgacagcattacttttcacagcaccaattttcgttattggactttatttcctttaatttcaggacgagtggtcaagttttgtaaaagctttacccaaaatgaccacttttttatcaccaatcattccataaaaataaggaagcaactatgaaaaatgtcgttattgccagtgcggtgcgtaccgcaattggaaattttggcggttcacttgcagacacctctgctgtggaactcggtacagctgtaatcaaatctgcgattgaacgagcaggtattgatataactgctattgatgaagtaattatgggaaatgttttacaggcaggtcttggacaaaatcctgctcgtcaggcactattatgttccggcattgctcaagatgtaccagcttatactgtcaataaagtctgcggttcaggcttaaaagcagtagttctaggcactcaagcaattaaagctggtgatgctaaggttatcatcgcaggtggtatggaaaacatgagccaagcaccttatcttcttgaatccaaatctcgttggggctaccgattaggagatgcaaaagtacaagatgtgattttatctgatggtttgatttgtgctacaaaccactatcatatgggtatcacggctgaaaatatcgctaaaaaatatgatattacccgccaaatgcaagatgaattagcacttgcctctcaacaaaaagccaccgctgcgattcaatccggtgcattcaaaaatgaaattgtaccgttaaatatcaaaattaaacgcaaagaggtcattttcgacactgatgaatttgtcaaacaagattcaaccgctgaaggtttagcaaggcttcgtgccgcatttgataaagagggtagtgtaactgccggtaatgcgtcaggtattaacgatggtgcggcggcattagttattgttgaagaagaaacggcaaaagcattagggttgaatattcttgctcgtatcaaaggttatgcaagtggtggcgtatcaccagatattatgggaataggacctgttcctgctactttaaatgctttgaaaaaaacaggtttgcagttaagcgatatagacttaatcgaagctaatgaagcttttgcggcacaatttttagctgtaggtaaagagttaggggttaatcccgaaaaagttaatgtcaatggtggagctattgctcttggtcatccaataggtgcaagcggagcacgtattctagtcactcttttacacgcaatgcaggctcgtgataagcagttgggtttggcaactttatgtattggtggtggtcaaggcattgcaatgattgtggaacgtatttaataccaactggaaaaaaaggaaaatattatggttaaaaaagtagctttaattacaggtgcagcaagtggtattggtttggcaatatgtgagagccttgcaaccgaagatttaaatatagtgatggtggatgtaaataaagagacattaaaagaacattccactcgtttaggaacggcttatattcaagcagatctttcgaaacgtgaaggttgtaaaactgcggtagattttgcagccgaaaaatttggtagcgtagatattttggtaaatgtagcaggtatccaaaatgtagccgccattgaaaatttttccgaagataaatgggattttatgattaacttaatgcttactgcaccatttttgcttactaaatacagttggaaatacatgaaagcaaataaatggggacgtatcattaatttgaattcaatccacggtttagttgcatctgatttcaaatctgcgtatgtttcagcaaaacacggtttatcgggcttaactaaagtagctgcattggagggtggtgaatttggtattactgttaattctatctgtcctgcttatgttcgtacaccgttggttgataaacagatcgtagatcaagctcgtaatcatggaatttccgaagatgaagttattagcaaaatcatgctttctaaagctgctgttaaacgcatgattgaaccttcagaactcggcgaatttgtcaaatttctctgttctgattcagcagcatcaatctctggagcttgcttaacaatggatggtggttggactgctgcctaaaaatttatggaactggggaaattaatggaaataatcccccgagtttctctttaacttaagaggaaatatcatgagtactatcgcaattattctttcattattgatgctgatgtacttcgcatacagaggtatgacagttttattattagctcccttactggctgcttttgctgtcttactaagcggtgatggatcaatgatgatgccaaaatatacagaaacttttatgtctgcattaagtggctatttacttaattttttccctgtgtttctatttggggcattattcggtcagttaatggcagattcaggtgctgcaacaggtattgccaaaggtattgttaaaatgttaggaagtcggcaggcaattcttacagtgatcatcgcttgcggtcttttaacttatggaggcgtgtctctttttgtagtagcatttgcgatctatccgatttcaaaagtgctatttcgtgaagcgaatattcctaaacgtttgattccggcaacgattgccctaggttcatttactttctcaatgacggcattaccggggacaccggctgcaaccaacgcaattccaattcctttttttaatactaacgcatttgccgctccgggattgggtttaattggtgccatgatcatgttgataggtggttggttatggttacaaagtcgtgctaaaaaagcagcttctttaggtgagggttatggtaaacacgatagtgaatcaagtgcggatttagctatattcgagaaaaatgtaatgccatttagtttatcactacttcccttagttcttgttatcgccatgaatgcaatttttacttatactttttccaatatggactttagctcattgcaagaggtctttccaaatctcaacattaaaggcaagactggattatgggcaatcatcgcctcattattaattgcatgtgtagtattagtatttttacgtcttggtaaatggacatcattacaagaaactatcaataaaggtgtatatggttcaatgttacctatttttaatacggcttcagaagtaggttatggagcagtagttgcttcattagccggattcgctattattcgagattcagtgctaaatgtatcaactaatccattaatttctgaggctgttgcaatgagtgcgcttgctggtattacaggctcatcatcaggaggattaagtattgcaatgagaacgcttggagcagactacctacgtatgggaattgaggcaggtattgatccggatttattgcatcgagtagcagtaatggcagcaggtggatttgatactttacctcattgcggtgcaataattactttactttctatctgtcacttgaatcataagcaatcttacttgaatattgcggctgttaccattgcaataccaatagtagccgtcattagtgtgattgcattaggcacagtgtttggttcattttaagtacaaataagtcgaaaaatggaaagcttatcctgcaagtagttaaattttaaaaatttcttataggaaatgtagcaaaaacagaaagtgaaatacttatggaactgttacacgatatcaacaaaattaacccacttaaaaaagtgggttaaatttaataaaaaggtttatttcaagcaactaaaatagctatctgcggtatattgtaagaaattggcataggaatttttacctaatttaactttgtcacccatcggatccaagcgtccaacgtttacacctgttgctttacctaaactttcaattacttttggtgtaaattgcggttctgcgaataagcaatttactttatgctcagtaatttcttccttaattttagctaatgtttttgcccccggtgcaactaatggattaatagtgaaatagcctacttgatttaatccataagcgttattgaaatagctgtaagcatcatggaaaacataaaatccattttcttttactgaagctaattgctttttaatttcgttattttttgctgctaaagtgcggttaaattcagcaagatttttttcaatcaatgcttttttagccggatattgtattgacaacttctctgctactttttgtgcaacaattttgctaatttccggtgagtaccaaacatgccaattaatgcccaattcatcatgttcatgattgtgtccatgcttgtgttcatggtcatgtttgtggtcgtgatcgtggtcatggtcatgtttgtggtcatggtcatgcttgtgttcatggtcatgtttgtggtcgtggtcatggtcgtggtcgtggtcatggtcatggtcgtggtcgtggtcatggtcatggtcatggtcgtggtcgtggtcgtggtcatggtcatggtcatggtcgtggtcatggtcgtggtcatggtcatggtcatggtcatggtcatggtcatggtcatggtcgtgatcatgatgatggcctgtcattaaaagtcctttagtattaatttctgaaatttcagcaatggtaactacttttttcggatctataccacgtaaagttgcatgatctaaaaacgcatccacatcttcgccaatccaaacaactaaatctgctttttttagtttttgaatatcggaagggcggaaactatagtcatgcggagaagcacctggtggaacaataacttgggtatcagttacaccatcagcaatagatgaagcgataaaacctaaaggtttaattgatgttactatgctagcatttgccacagcagataaagaaaaaagtgctgtactaattaatgcttttttaaaggtaaaattagacattggaatactccttttcatgattaataacgattttaaaagacggactaggttatcactttttcatcaaattactagaatttttacaaaactttttagcctttggctaatttatttattatttttgctactgcaaaaaagccaaaagtcgctgttatcattgttgctgcaccaaagccattggcacaattcatggtagctgaagtagtacaattatcagccatttttggaaaaattaaaggctgagtggaaaagacacaatcgactacaaacttacgtttaggattttgcggaaaatgatattctttacgtaaaaccgaccgcacttttgccagtaaggggtcttgaatagagcgactaagatctgctactcgaatttgacttggatcggtttgtcctcctgcaccaccaattgtgataatcggaattttattgcgtttacagtgagcaattagtgctgcttttactctgacattgtcaatagcatcaatcacataatcgtagcctgtatgaatatattcagctaaattttcaactgataaaaaatcatcaataatattcacgtggcaatccggattaattaattgcacacgttctttcatcacttctgtttttaacttgccgatattacctgttagagcgggtaattgtcggttaatattagttacacagatgtcatccatatcaatcatggtaatttgcccaataccgcaacgtgcaattgcttcgacaacccatgaacctaccccaccaatgccaatcacacaaatatgtgtttgctttaagcgttccaaaacgtctattccatatagtcgtccaattccaccaaagcgttgttcataattatcaatacgttctgtcattattgtaataaccacactctaccatagtgcttcgataaacccgcaatatgtccggcattatcgccaattccacgatataaatcaaaatgctgcccttttactgctcctccaacatctaatgccaccattaaatgtaaaatatgttcaccggtccaattgccttcatcatcaattttcggtacttccactaaaactacagagccgcttgggatcacatttttatcgctagcaatagcagccataggtactaaaggcacaccggcagaaccaagcacttttccgttaggatcttttttgaaaaaaacataagaaggattacgttctaacaaggcttgtaagcgtgatggattttccattgcccaatttttaatggcttgaatagacattttttctttggaaatttcgccatcctctaccagcaatcgtcctattgctacataatcaaaaccattttgtcctgcataggcaaaataggtcaaatctccgtgaccaaaatcaacataaccgctaccttgtacgccaagtagaaaattatcaatcattgaatcagtgtaagccagctcaagtcccttaccttgcaaggcaccggcataaatttgagctcgagaaaaacgtttattagcaggcaaagcataaataggttgattatatttgccctgttgcgtatgacgagcatgaataaccggcgaataatatcctgtcattaatacattttggtatccgtcggttcctttcataatttgagcttgaataccatagtctgctaattgtttagtattcgcacccgccaatacccaatgagttactttgtcataaatgttcgcaaattgattagctaagccagttgatgcttgacgaatattagtaagttgcgttaaaaaatcaccttgattgatgaccgcacttttgttgtcaacagaggaaaccggcactaatgacgcttgctgataactacgcccagcatattttgccccgaattgtttcgcatcattttggctagctgttttagagtgttcggaagaacatgcaaccaaaatagtgaccgaaaataaaatactttgtttaactactgttttgataaaaaataccatatgttaccgaaaaaccgcataattagagacgtcttaaattagcaaaaaaactgtagaatatacagtcttttatcattcaatgaagataaaaaatttacaatttgcttcattttatcattggttgttttgttatttacactgatgcaaaatgtttttacgcttgaattgtcaaataaaagtgcggtgttaatttagactactttgagtattgcaacgtcagggcttgattttgcagtccaagccctcaaaatcatttaaaactcaccgcacttttaggcttcatcaattccccaaagccaagccgccccacgcacaccactggaatcgccgtgtacggcttttttgatttcagtaaaaaattctctaccgaaaatataatcgttcatccgtgtcggtaaggttgtgtacagacgatcaatgttacaaacaccgcccgccagtacaatcacatcaggatctaaaatatttacataagctgctagagcttttgccaaacggcgttcataagcttgtaaagattgttcggcagtaggatcgccttgctcggcaagtgcggcaatttcgttgccttttaatcttatcccactccgacgttcgtaatcatcacatagaccggtaccggaaacaaattgttcgatacaacgatgtttgccacaataacattgtacgttatgcgaacgttcttcttcatcttgccaaggtaattcgttgtgtccccattcaccgccgataccgttagccccattccaaggttttccgtcaatcacgataccggaaccgcaacctgttccgagaataagtgccaatacgaccttttttcctgctcctgcaccatctgtggcttcagagacggtcatgcagttagcatcattggcaattcttacttctcgtcctaaaagtgcggtcaagtcttcgtctaaattttgtccgttaagccaaacagaattagcatttttgactttgccggtaaaaggggaaatagtgccgggaattccgatccctactgtgcctcgttgccctgttgcatgttccgcatcatctaccaaacttttaattgctgtcaacgtgtccggatacgaccctcttggggtaggaatacgtttgcgaaacaactcttcaccgctgttacttaatgcaataacttcaatcttggttccacctaaatcaatacctatacgcataaaaaactcctataaatgaaatatgaatattgtgatccttgtaacattattttattttgatattttatatactttcctcctttaaaattattatcaggtattaatgtccaccagcatatcaattttagtcattgatgacgatattcaaatttgcgagctactcaccgatacttttgaagaatatgggtatagggttgttgcagtctcttccggtcaggaagcattaaccttattacaaaccaattctcgctttgatttgattttattagaccttattctccccgatattaacggactggttttgcttcaacaattaaaaaatctgttgaataagcccatcattatgttgagtggcttaaatagcgaatccgatgtagttgttggtttggaaatgggggctgatgattatattaccaagcctttttatcctcgaattgtagtggcgagagctaaagctgctattcgtcgcactcaaccacaagccacaaccaccgtttatacgcatagcggttttttgtttcatcaatggtatttagataccgaaacacataaactttattcgccccaaaaacaggaaattgaactgactcacggcgaatatttattattgtatgccttagtttctcacgctcaaaaagtgttgagccgtcaaaaattattagaattaacccatgcagaaaatttggaaatttttgaccgcactattgatgtattaattatgcgactacgtaaaaaaattgaaccgaatgttaaggctccgagttttattcagactgttcgaggcctagggtattgctttgaggcttcagttgaaaaactgggagaaaattaagtacgctattatgcaactcaaatcctcactttttaagtattctgcattgtttctttggtacgaataaaatcctttaatttcacatagctgactgcaccttcagtagcagagagtgaaaataaattgaaatacgccaaaccgtgtcctaattgtaaggttttttgtaacggtaaattctgatgtaatccgtataaaataccactacagaaagcatctccagcccccaatgtactcagaattttatctttttcgacccagtaggaaggaaccgtaacaatatttcccagcaaatcacaagcaaccgcatatttaggtgaatgtacaataacggctttctttacacccagttgcataatcgcttttgccgtcgtaaccaactctttttctgtagaagctatatttacttgttccgttaaaattttggcttccacatcattaataatcacaaagtccacataggataagatcgggcgaataacatttttaaaaatctgtttattttcacaggaaaccaaatcaatcgaaataagaaaacccttttcttttagcactgtcaatgtttttaccagttttgagacatccagcaacgccggcagtaagggcaaataagcgatatgggcaattttagcattacaatctatcgaggtaacagtttgatgatcatattgctgcattgctcctatgtaatgaaaaaaagtccgctctccgttttgactgttaatcattacatcagtaaaggaagtggggagatcgctttctaacattgcggttaataccacattgtgtttcttagcttgccgtaaaataaattgtccttcactatcttttccaatagcaccacttaaaaataaagagagctcgggatccaatttagataaattgaataacacattagtacagccacccccacagtgtaatcccatttccgaaatagttgccaacatcgtttctttgggataatcggagatcactaaagttcgatctaccaataagtttcccaacgccaaaatacccttacgtttttgcataatatctagctttatcgatgctgttaaaaattttcaattgttcggcaacggtttgactaatcgcatgttgcatattattcattatcatcaagtattgattatatttgccacttaattctatggatctcatatccaccgctaaggtatctaatgccgtttgagacatgccggtaaagaaattgattttgcaaatacccaattcaatagttttacggaaatcttctgcactaattcctgaaccaccatgtaataccaaaggaacatcaacagcttgattgatttgtgcaaggcgttcaaaatcaagcttaggttcgcctttatatttcccgtgcgtattaccaatcgcaactgctagagtatcaataccggttttttctacaaattccttggcttgttccactttggtataaagtgctacatctgctatactttctaacgcaccgccttcatcgccacccacggcacctaattcaccttccacagaaatattataagggcgacataattccactatttctctagtttgacgaatattttcttcataagataaagaagaaccatcaaacataatagaggagaagccacattcaatggcttgtttgacggttggtaaagttaaaccatgatcgaggtttaaacaaactgggatacttgctaattgagctttctttttaatgtatttggcggtcgcaggtaaatcgatatattgcaaatgtacttccgcgacattaataatcaccggtgattgctgctgtttagccgcagcaaatactgcatcaataaaattggaatcaattgcattaaatgctcccacggcaaatttatgttgtaccgcaacggtcagcatttcttttaaattaattaacgacataaaaattccttataatcactacaaagtaaacggataggttgttcattttcctgaatggttgaaaaacgtccaagagattctaaaaaacggttatcggtgagatcatcatttgtcattgatacctcaccaactaaaacatcgctatcttccgcccaaaagctgtggtagagcattggtggtaagcaaatactttggcctgggctaagacgaattttgctacctgcggcaacttgatattgttccccgtctatttgaatatcaatggacgaaaccttatctagcagctccgttatttcatcacgcctgtataactgaatgactaaaatgccaccgccacgatttataatatcttccatttttttccaatggtagtgcattggcgtaatttggttttgcttcaccaacataattttttcggcataaggtttattgtttctatccgactgattacgcaaggtaaatagggtcaatcccgcctgtttgaaattacctaaattaaaatccgtcacatcccagcccaaatttgcttctagtatttcagcatagcgttccagagaaagtgtatgccaatccgctagtgaaaaatccgcaaatttcggcagtacaaagtggtattttgccatcatttgctgtgcttctctgatcgcttgattaatttccgaacgcttcatattttatttcctgtcatcaaaacaatgaaaaaatctaccgcactttttagctgttgataatatgttaaagccgttgcacaaagggaacggcttggtttttctataattattttacagtccaacctttgtaatctttgatgttatcgcgattaattaaggttacaggaatcaagaccggtttttctggtgcagctttaccttgtaaaatatcgtaaccgatttctaccgctttcgctgccataacttgcggatcttgtgccggtgtgccgttaaacaagctattgctttgttttaatgcatcttcaccgtctggagaaccatctacacccatgataaaaaattctttacgttgtgcctgtttcgccgctaagtcggcaccgattgctgtcggatcattaattgcaaatactgcatcaattttcgggtgagcgattaataaggaagtcattacttctaaaccaccttcacgactgccttttgcattttgattgtgagacaataatttgatccctttatgcttagccaatacatccatacaaccttgaacacggtcttgtaccgcagaaactggtggaccgttgatgataaccacattacctttaccatttaatttatcggtaatggtttgacatgcaatttcacccgcttggtagttattggaagtgacggttgcatttgcaccatctgccgctacatctactgccacaacaacgattccggcttttttcgcacgctctactgcaggtcctatacctttagaatctgcagcatttaaaatgatcatatcggttttcgctgcaatgaagttgtcaatttgtgctacttgttgacctaaatcgtagccactggacacggatgtcacattcactttatcgccagctagttcttttgcttttaactcagcacctttggcaatttgcacgaaaaaaggattggccaaatcaccgactgttacaccgatagatttaagttctttggcttgagccaaaggagccatggccaacataacacttactgctaatgtttttaatttcataaaatatctcctatgagattatggttaaggaaaagtttgagtaatttacccaaattagtttgctttactggtacgatacttatcgatgagtactgctacgataattacgccacctttaatgacaagttgccagaaataagatacccccattaatgtcataccgttattgagagttgcaatgatcaatgcaccgattaatgtgcctgtaattgtaccgataccgccaacgaaactggttccgcctaaaataaccgcagcaatagcatctaattcatagccaacccctaagttaccgttagcactatataaacgagaagcactcatcacaccacccaaaccggataataaaccgctggtagcatacacaaaaatcaacactagagatactttgataccagttaaatgggcagcctgtaaattcccaccaaccgcataaatatgtgtacctaacgttgtgcgacgtaaaataaaccaacataccgcaattactgcaaaggcaataatgactaaccaaggaatagagcctagataaccgttaccgatccagtcaaaagaaatttttgagttaatcactgttgtgccgtcagccactaagtaagcagcaccacgaagtgcggtataagttccaagcgttacaataaatggtggcaatcctgcataagcaaccaataaaccattaaaaacacccatacctaaacctgcaactagagcaatcggtactgcaaaatcggcaagtgcaggatttaacgaacacaccaatgccatgacggcagttactcctaaaattgaccctacggataaatcaattccaccggttaaaatgatgaaagtcattcctgctgccaagacgatattaattgatgcctgacgggcaatattcatcatattggcttcactcataaaattgggggcaataaaggaaaagacgataataatcagtagcaagataggtaaaatacccattgcttggaacatatccgataatgcctgttttttagctcctgattttgctacattttccatattaagctccttacatctaaatttacgctgcaccacaggccaatgccataatgctttcttgattaatttgttcacctagaacttcaccgacaacatagccttcccgcattacataaacacgatcgctcataccgacaatttcaggtaattcactggaaatcattaaaatcgctacaccttgttttgccatttcaatcatcattttataaatctcactttttgcaccaacatccacacctcgtgtcggttcatctaaaatgaataacttcggatgaattcccatccaacgggacaacaatactttttgttgattaccgccggatagtccactcacatcgacattagcattcggcactcggatttttaaacttttaattgcctgatcagtatccgcttttccttttgtctgattaatcaccatcatggtggcatcacgttcaatggtcgcaatagttatgtttttaaatacgttcatatcaaggaataatccttcttctttacgattttccggtaataatgctacgtgatgaataatggcttctcgaggtgagctgaaactaatttcggcaccgtttaaatacattttgccttgtgtaggtcgactaacaccaaataataaatgagctaattcagaacgacctgcaccaaccaaaccggataagccaataatttcacctgctcttacaaccaaagaagcattttttattttattaccgtcagaaagattttcaatgcgaatgacttcctcgcctattggtactttttctttattaaacaaatctgttagtggtcgtcctaccatcatttgtactaaagtgttggcatgcaaattctcacgtagtaaagatccaacatactttccgtcacgtaatacactcacacgatccgccaattcgtaaatttccgccattcggtgactaatatagataattgccaatccttccgaccgtaattttttgatcaactcaaacaatttttctgtttcacgggaggataatgcagcagtcggctcatccatcactaaaattcgacttttacgatgtaacgcgcgggcaatttctacttgctgttgctcagcaatggtgagagaggacactttttgataggcgaaaaattgagcacctaaacggtctaatacttcctgtgcttcttcttccattttcttgcgattcaagccaaataccgtaccgatttcacgacctaaaaaaatattttctgcaactgtcaaattcggtgaaagatgaatttcttgataaattaaagtaattcccgcaagaatggcatctttcggcgaagaaatcggaaagagtttgccgtcaatgttgatttcaccggaagtagcaatatacgcacctgccaaaattttcattaatgtacttttaccggcaccattttcacccattaacgcatgaatttcaccacgatatacatctaaatcaacatcttgcaatgcataaaaatcgccgaaacgtttggcgatatgacgcatttccaacaacggtgttacggaaatattgacagcctgctccattttaattgccctcaatctttattttgatttacagtaaagcataagtttatgaacagaacatgttaaaaactcattcatatttgtcataattccataatagaaactatttataatgtcacactcggtcaaaagtgcggtaaaaattacaaaagttttattcagtcggtagttatatgttaaaaaaacttttttctactcattcctacggtgttagattacgattgatcgtattcgtactggtggcagtttttctgattttttcaattagtgtgatgtctgtatttggattgaattccagtcataacgccctgtcaaatttacgtgatcgctccatgaaccaaatgtttttctccatgagtttaggtatcaaaaccactcagatttccacttatgccaataaactcaggcagacctttcgtgcattagaatatcaggaagcgtccaagcaactggcacagcatattgagcaagtacatcattatttggatcaaggcaaaaaatacgccagtccgttagagcaacatcaattttcagggattattcaatctattgacttattggaaaaaagtgtgcaagagctgttacaacaagcctatcaacgccatgttttgaataccagcatcatcagcaaattaaaccaatccttactttatttagaacacattaaaaggttagaaaaacgcaccgcacttttagcagacggcaaactgtttgtttctgactttcaacaaattgaaaacttgattgaaactgcgactaaaggtttattttcacctgaaacctttattgccattcgctcagtattttcatttttacccgagaaaaaacagccagatattcagcaagaatggataaaaatagaaaatgaatttgaacttatcactaaatcagcctaccaattggtagcgattaatcaacgtattcaattcttaacttatcaaattgattcgcttgtagctcaaattgaccgagattacagccgtttggcacaagaaaaaatcgctattgtgaatagtgaatctgcaaaaattcaaaccgcactttccaagcatattttgtatatttggggagcttctttattcacagtcggcttgattatcattttgggtatttatatttatcgcttattcggtaagcgtttgtattctattactcaggcgatgactcgcttatcacaaggggataaatatgctcaagtaccgcaacaacaacgacaagatgaaatcggcgaattagctcgagctttttatatttttcagcaaaatgtggtgaaactagcacgtaccgatgccttattgaaagaaaaaagtgaattgttggagcgaacttttttggcaatgcgggacggtttggcgatttttaatccctccggttgtttaatgtcttgcaatagccaatttatacaattattacattggcatgaagagcaagcacgagaggctaatttttcaagtctagcgttctttttacagcaaggttcagcaaaaatttatggtagctcggagcaaattaatgaaaaattattaagtgaaatgcgtagtgagcaagaaccattggaaatcgactattgccggcaaattttggaatggagggtaagtgccttacaagacggtggtttggtggcgtttttaattgatcgtactcaacgtaaaaaattggaaacggatttagcacacagtcaaaaaatgcgaagtatcggtcatttaaccggtggaattgctcacgatttcaataatttattggcggtgattattggtaatttagatttgatagatcctgaaactttacacgacaaacaggcaaaacgtttgcaacgtgcattaaaagcggcagaaaatagtgcaacattaacacagcgtttgctggcttatgcccgcaagcaacctctccatccgacctcattagatttaaaccagctattatttgaattttccgattttatgaaacatagcctgccagcaacgattacagtgcggttagatttagcggagaatttaccgctgatttatatggataaaaatcaattggaaacagccttggtgaatttattggtgaatgccaaagatgccttagagagtaaaggcgaaattgtgctgaaaacccgtcaattattagtccaacgaacccataaaaccgaacaaatggtgcaactgtcaattattgataacggttgcggaatgagtgaagaaactcgtcgccatatttttgaacctttttttaccaccaaacaaaacggtaaaggtagcggtttgggattgtcgatggtatatggatttattcgccaatctaaaggaagggttaaagtacaatccgaactgggtaaaggcactaagatccatttacagctacctatttcccgcagaaattcaacaatttccaccgcacttccagcgagtatggatttatctgaacgagcgacattaatacttatcgaagatcaaaaagatcttcgggaaaccttaaatgaacaacttatcgcaatgggctatcaaactctcgtatttgaaaatgcggaacaagtaatgtcgcatttatcgaaaaacgaacgcatagaatatgaatatctgttatccgatgtggttttgaacggcaaaatgagcggtattgatttagcaaattatataaaataccgttttcccttaatcaaaatactgctaatgacagggaaccatacggaatacatcgctcagttcagtgagtttgaggtgttaaataagcctttcagacaagaagaattattggttcgtttgaaatctttatgataaagaagactgtagcaaattcctgtaattaaagtgcggttgaaagtttttctattttaaccgcactgagtttaagcataaatacagttattgactaaattttatgttatacatcgtaaatatgcttaatcagactcacaaagaatttagaaaatcttgttttatttttgtgatcttcatcacgattttatggtttgaatttataaattgtgataaatatcacgtttttatcactgattaaataataaaaaatgtgtcctacatcacaaatcttaaagaaaaaatttttgcttttattataaatatgttattttttctgcctgaaaaatagccaattatttctctttacgcgttctatttattgaggttaagttatgctatcagcaaatgcaaaagtcaaaatccaaagtgttggacgtttcttatcaaatatggtgatgcctaacattggggcatttattgcgtggggttttattaccacactttttattccgacagggtggttgccaaatgaaatcttggcgaagttagtcggaccaatgataatgtacttactgccattattaatcggttatactggcggtaaattagttggtggagagcgtggtgcagtagtcggggcgattactactgctggtgtgatcgtcggtacagatattccaatgttccttggtgcaatgatcgcaggtccaaccggcggctgggcaattaaacgttttgacaaatgggctgatggcaaaatcaaaagcggttttgagatgttagtcaataacttctcttccggtattattggaatgattttagccattctattcttctggatcatcggaccggctgtaaaagtagtttccggttggttggctagcggtgtagatgtacttgttcaagcaggcttattgccactcacctcaatttttgtcgaacctgcaaaaatcttgtttttaaacaatgcaattaaccatggtattttttcaccgttaggtatccaacaatcacaagaattaggtcaatctgttttcttcctaattgaagcgaaccctggtccgggcttgggtgtgttgttagcttatatgttattcggtaaagggtctgccaaacaaacttccggcggtgctgctgtaattcacttctttggaggtattcacgaaatttattttccttatgtgttaatgaacccacgtttattaattgcagtgattgcaggtggtgcaacaggcgtatttacattggtattatttaatgcaggcttacaagcaccagcatctccggggtcaattattgccgtgttagctatgacaccgaaaacctctttcatcggtgtgattttatctgttatcgcctcttgtaccgtatctttcgtcatttcttctttcttcttgaaaatttcaaaagaagaaagcaaaaataccctagaagaaatgcaagccgcttctaaagcaatgaaaggtggtaatacagcaacgaaaagtgcggtaacagatttgaacgaggtgaaaaaaatctttgtttcttgcgatgccggtatggggtctagtgcaatgggtgccggaatgttacgtaaaaaagtaaaagatgctggcttgacaattgatgtaactaactgtgcgattaatgatttaccagaagatgcccgtttagttattactcatcaagatttaaccttgcgtgcgaaaaaacaagttccgaatgcaatacatttgccattacaaaacttcttagataacaaattctacgacagtttagtgcttgatttgcaagctgcaacaaaagatactgtagtaccgatagcggaagaaaatgcgattgacgtcaagggtacaacatttactcttaacgcagagcaaattttcttgggcttgaatgcagacagcaaagcggatgcaattcgtttcgccggtgagcaattggtgaaatttggtttcgtgcaaccaagctatattgatgcaatgtttgctcgtgaagaattagtttctacttatttaggtgaaggtttagccgtgccacacggaacagcagaagcaaaagatgcggtgttgaaaaccggtattgtagtttgccaatatccacaaggcgttcgttttaccgacgaagaagacggcgtagcgaaattagtaatcgggattgcggcgaaaagcaatgagcatattcaagtactaaccgcaattactaacgcattggatagcgaagaagccattgcaacactaacatcaactgatgatatagaaaaagtgctgaccttattgaaagcttaaaagtgcggtaaaaaatggcgtagttttgactacgccatctttgtttataattttattgattgggagagcaaaatgaacgcattacatttcggagcaggtaatatcggtcgtggttttatcggcaaagtattagctgatagcggagttcaagtaacctttgccgatgtgaatgaagcggtaattgatctattgaaaagacatcagtcttacaacgtgaaaatcgttggcgacagcattaatgcgatggaaagcgtacgtcatgttacgggggtggattcaaaagacacaaaggctttgattgaactgtttaaaacggttgatttagttaccactgctgttggtcctaccgtgttaaaaattatttccggcactatcgccaaaggtattgaagctcgtttagccgcaggcaattttaagccgttaaacattatcgcttgtgaaaatatggttcgtggaacgacctttttaaaagagcaggttttcacacatcttacagaggaattgcaagcagacgctgaaaaatatgtaggtttcgttgatagtgcggtagatcgcattgtgccacctgtgcaagaagatatatcggatcctttgttggtaacagtagaggaattttgtgaatggatcgtagataacacccaattcaaaggtgatattccaaacattcaaggaatggaattaactgataatttgatggcatttgtagagcgtaaattattcaccttgaatacaggacacgccgtgaccgcctatttcggcaaacgcaaaggctatcaatttgtgaaagaaagcattgaagatcccgacatcaaagagtttgtagcggctgtcatgcaagaaagcggtgcagtgttaattcagcgttacggttttgaaccgcaagcacatgccgcttatattgaaaaaattctcaagcgttttgctaatccatatttagtagataatgtggaacgtgtgggtcgccagcccttacgcaaattaagctacaatgatcgcttaatcaaaccattgcgtggtactattgaatacaatttagctaatcagcatctaattcgtgcaatagcttacgcactgactttccgttgtgaagatgatccgcaagcagtagaattagcacaatctttggcagaaatcggtgtaacagaaacgttaaaaaaatacacggaattgcaagatgtcgttattattgagcaaatagctcaagcctataatgaagtaaataaatcttagacaaaagagcggtcagtttgcaaaacttcctaaaaaatgaccgcactttctctttcaagcataggaaaaacaagttgttatctgaagatcctatttatgaaaaattaaacagtactgtttccgtgcgaggttttatgattgctactgtggcaatttttgaagaggcggtagatagtctgatcaatcgagtatttcgaaaaacagattttgtggtgcagtcggtgattgactctctttttaccaacgatggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttgatcatttaaataaattggtacacaacacaaaggtaagcattgattttacagctaaaaacgcatcttaaaaaacaggtaaacaggtagtataagatgtctataatgaattttttagctgtaatttttccagtaatttctgatgaattcccccaaaactaccatttgacatgaccaaaatatgatcttcaggttgtgcctcagtaacaattaaatcaactaagttgtccagatttccagaccattttgccggttgcacacaatcattagcaatttcaactacattccaaggaatattttccggttgcaataaaaaaacataatccgctcttgccaatgctggtgctatttcatctttatgaattcccattttcatcgtatttgagcgaggttctagcactgccaaaatacgtgctccgccaccgaccttgtctcgaagtgcggttaatgttgcaagaatttctgccggatgatgggcaaagtcgtcataaacagtaaccccatttacttcaccttttacttccaaacgacgtttcgcattgacaaaagaatatagtgcttgacaagcatctttgacttgcacgcccacatggtaagctgccgcaatcgccataagtgcattattcatattatgttgaccgacgatattccattgcacttcaccggctttttttccctgatgataaacagcaaaatgcgaactgtcatgagctattctttccgtatgccattcctgatcttgtcccaaaaaatgcatttcagaccagcaacccatgtctagagtttcttttacagattgttcatgagcaaaggcaagaatacgaccgctcttaggcattgttctaatcatatggtgaaactggcgttgaatcgcttgtaggttgtcaaaaatatctgcatgatcaaaccctaagttattgataataagcgtttttggattgtaatgtacaaatttggaacgtttatcaaaaaatgccgtatcgtattcgtcagcttctataacaaaaaatggactcttacctaagcgtgctgaaacaccgaaattgccggctattccacctattaagaaccccggttgcaagccattttgttctaaaatccaacttaacataccggttgttgttgttttgccatgtgttcccgatacggcaagcacccagcgatcacgtaataaatgctcgtgtaaccattgtggacctgaacgataaggtaagctattttccaacacatactctacgcaaggattaccacgtttcattgcattgccaatgacgactaaatcaggtgctggttgcaactgcgaaacgtcaaagtgcggtatgatttcaataccattttgttgtaaaaaagtactcatcggagggtaaatattcgtgtctgaccctgtgattttatagcccatttgtttggcaataatagctactccccccatgaaagtgccacagatacccaaaatatgaatatgcttattgttcatttgtttctattccccaaaatgtataaaaaatgtgttatagatcacattgtgagaaatcaattcattcgttaaaaagtgaaggttgttataataaagcaactccaactgagagtaaatttaaattatggaaggattaaattatgaaaacattaggacaatttattgtagaaaaacaagcagaatatcccaacgctaaaggagagctatcagggattctatcttccttgcgtttagttgccaaaatcattcatcgtgatataaataaggcgggactaaccaacaatattattggtaattccggcgttgaaaatgtacaaggggaaacgcaaatgaagttagatttgtttgcacataatacaatgaagcaggccttgattactcgtgaggaagtggcaggatttgcttccgaagaagaagaaaattttgttgcctttgatactgaacgtggtcgcaatgcaaaatatgtcattcttaccgatcctttggatggttcctcaaatattgatgtcaatgtggctgtcggtacaattttttcaatttatcgccgtgtttctcccattggtacacctgttaccttagaagattttttacagccgggacataaacaagttgccgccggttatattgtatatggttcatcgacaatgttggtttatactacaggcaacggtgtaaacggctttacttatgacccctctttaggcgtattttgtttatctcatgaaaatatccaaataccgccaaacggtaaaatctactccattaatgaaggacagtatttgaagtttccaatgggggttaaaaaatatattaaatattgtcaagaaaaagataaatctactgaccgcccttacacttcacgttatatcggctcgcttgtttctgactttcaccgcaatatgcttaaaggcggaatttatatttacccgagtgcaacgacttaccctaaaggaaaattacgcttattatatgaaggtaatccgatggcttttcttgctgaacaggcaggagggatcgcaagcgacggcaaagatcggattttagatattcaaccgaaagaattacacgaaagagtaccgctctttgtcggctcaagagaaatggtcagaaaggccgaagaatttatgcgtgaattttctgaagaataaccatttgaaaagacactgttttgtgtcataaaaaatctgcaccttaatcagttgattatttagttcaacttttggggtgcagattaacatgtatatcggttttgagccttacttgacagaaattagaatttataatttacatttaaaacaaatgtgcgtcctcttgaatagttatttaaggttttctggtacccatcgcccacaccaaaaataaaggtcatttggcttgcagaatcattattcgcatctaatgggctaatatatcttttatcaaagacattttgaatttcccctttaatggttaaattttctgtcggttgatagatggcataaagatcaaaaatcaccggttgtgctttgatttcttctgtaccggcaatccgcacataagtaaggtatactttgccatctttagatttgaacgtccccggtaagataacatcgccatctactttatcaactttagctcgtttacttttaccgtagtatttggcaatgccgcctaatgttaattttccgtcaaataaacgtgttcctaggtcaagggaaccgtaatctttcggtagagacgatattttacttaagccgaacccttgtaaatattttccactgctactaccgtcatttacagcactactggaatcggaatatgaacttggctgattggttttttgtctagcataggataaattggcatagaaccaaccgatatcataatttaattcaaattctattccttgcattttaacaataggcgatgaagcaacaggaatgatctccgcttccgtaccgccggtaaactcttgtggcttaaaaataccgtgagtttgtgctgctgctgtagaactaagtttattttctgcttttttatagattgttttacccccttcgtagttaatatgggtaatatgtgcaacgcagtcatcaacggatacaggtttatcttttcctctatagctgttcgagctacattcctgtttgacatttaaaatataatctctgattttcgtttgatacgccaagattttaaagcccagtacgtcgaaatccgaaaatacgccatttttataaccgttaatcccgaattgaatagttttggctttttctgattttaaatcggttctcaccgctaaatcaccgatttcagagaaatacatttctttgatatttgggacacgatgggttttggcataactgacaaagggcgaaaagagcgggtgaaaatccgccgagaatgaagccgaataattatcatgtgatctggaaccgcctttttctagggtatattccataggtctacatctagcaatatcaacatacccattataaaattttggagtgcatcctaattttatggcaccttctactccgtataaatcaacaagatcttttgaggtattatctacccatacagtgagacctcgatatttttttcttgtctcatcccaagctccattaataaacctattccgtcgaaaaacctgtccactgtatttataaatttggcgattggcatttaattttaaggtataaatatcgtatttaaaggtttggtcaaaatagagggttttaaaacgttgttcgccgtcaggttggaaagtattggattttgtgctgtgataaaaacaaggaagataacccggttcacctctattagggcaataatataaattcggagcaaaagttggctcaccatcctcaaaattataggctaattcacttggatggcgatttttactgtatttatttttgaggatattggcacctaatgttgcttcataagagaatttttctgttatcggaatggaaaaactcatatttatatccatggtttttgcactatttttgctttccaacatatctttcagctttttgccattaaatacgcttcccttgtgataggtttgcgtagaggtattatccgccaagattagttcaaattgtaaattctctttcgggtttaattggtaatttaactggtaatttttattctctaaatttctgccggaaagtgcggtcgataaagtgcggtatgaaagaatggctttattatatttatcattatattcaattttggctaaatggcttttgggataatggagtaatttattcgggtcatagggttgacgattgtacttttctattgcttctagagtacaactatctatccaaaatccccctttacaactttctcgtgccagtctcggtaaattatcttctctatctacatctacaatatttgttccaccacctactttaaaattttgcgagcttttacgccaactatacgcatacataaaacctaatgttcttgtatcggaaaaaggatagcgaaaagcaaccgcacccatataattaggccctatagcgtttgtaccccccccgcattcaataaaatacccgctctattactttcacttatcacatcatcaacaccgattgttctaaagttagcagatccgattaacccatttacaccgccttttccgctaacgccaccacgttgaatatctacactggtaataaacgcagggtcaatggttgcaccgaattgagaggttccaccggatttttcgctgttatctcccgatgtggcaaaaaaggtttgggaaataccgtccaccatcgtattcacccgtccaaatcccgtttgaccacgaacgttcaccgacactgtccccgaacttttatcaaggttggtaaacgcacccggtaccgttctgatgatgtcatcaatagactgcgttgatgtggaaatattttctctcacactggtcgctcccgcttttttaaagacttcctgtttaggtggtagcttatattctacgttaatttgatcgagcatttcttccgcataaacacaagtgcttaatacggaaaaagctaccgcagtgagtttaaatttattagacataattttcctacttatgtatggttaaaaagattggtaaaaaagtagggcagttatataaaaatatccctcgcatgtcaattaatgataataatttttattattgttttatttccaagaatatgtaaagcctactgtgccattgcatttttatacaccaaatctgtaacgccaaacacaacggcactgtttcccgacttaatgtccgcactggcagtgtctgccgaggcatctaatttggaatcgtcagcgactaataaaatagtcggtgcattaggtgctatttaattgcattttaccggtcgagtagcaacgttccatttgattttaaagatggtattcatagtgggattccttgtgtgaaagataaaaaataagacctagttctcatatgccaagaactaagcctcatcgaagaaatgaataaaaaagaggtgtattcgttagttaaaaacgaatacaatcgtgctgtgctgtcatcatagattatgaatttcttgcgtcattcttcaaaccgtctggttgtataaaaaataaatctttttgtctaactctaacaaagaaataaaaatacgtttatactgaaaattttaatttctttgttttcattgcataatagtaaaaatctcatagatggaaggaaaaaataatgaaaaatatgttactgatgagcagttctaaatacaaagataccggttacttaattcatacactaccttggttggatcaatttttgatggcatataaaggtaaaaagctcgcctttatcccttatgccggcgttactcgttcttttgatgaatacgaaatagcggtgcaacaagctttatcttgtttaggcatggaaattatctccgttcatcacggcaaaaaacatgcagacattattgagcaagccgatgtgatcggcattggtgggggtaatacgttttgcttattacaacggatgtatgaatataatgtcatgaatattattcgggagaaagtaaataacgggacaccttattttggttggagtgcaggggcaaacgtagcgggtagttcaattatgacaactaatgatatgccgattatttatccaccatcttttactgcgttaaatctatttccacatcaaatcaatcctcattttatttcaagcaaaattcaagggcataatggagaaagtcgtgaggatcgattaaaagaatttttaatcatcaatccgaccgcacttgtatatgcgttgcctgaaggtactgcgttgcatgttcaaggagaaaaagcaacagttcttggtgaacaaaaggtgttacgttttagcgaaaatatgcaactgagtaccttagcacctcattcgacatttaattattaaggatataactatgatacagtttaattctattgtggctattcttggcattatcgccacggtttatcttctcattaaaaaatatgaaactcgtacagtattaatcagtgttggtttgttgatggcaatgttgactttcaaaccaatggaggcgttagatgcttttgctaaatccatgaccagtagcggtttaatcatggctatttgttccagtatggggtttgcttatgtgatgaaatacactcaatgcgatacacatttggtacatttaatgactcgtccgttaagtggtttaaaattctttttaattccgattgcaacagttattacgttctttattaatattgctattccgtcagcagcaggttgtgcagcggctgttggtgccactttaattccagtattgaaaagtgcgggtgtacgtccggcaacggcaggtgcggcgattttggcagggacttttggttcaatgatgagtcctggatcttctcatagtgcaatgattagcgaaatgtcgaaattgaccattaccgaagtgaatttgtctcacgcaccttacactatgattgcaggtgcaatcggcacagtagttttaactttgttagcgattgtatttaaagattacggtgaggaacatcggaaagcctatttacaagaaaatcaagaaacggaaagtactttcagtaaggtgaatatattctatgctttagcacctctcgttccgttgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcttatgccaatgtattagggatcatcattgccgcaagtgtgtttgttgcaggcttaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataaatataagtaatactgaccgcactttgataattcatttgacaaggtgcggttaaagtttggagagtttaatgggggatatatgacgaatttagctaggttaattgaatggcgaagagaatttcaccgttttcctgaaactggttggacagagttttggacaaccagtcgcatcgctgattatttagaagaaatgggggctgagattttactcggcaatcaaattattcatcatgattttgtgcgtggtcgtgatacgaaattagttgagaaaggcattgaaagtgctatttcttatggtgcaaaaaccaaatggctagaatgaatggctatacaggttgtgttgctgtatttgattctggtaaacagggaaaaaccttggcattacgctttgatatagattgtgttaatgtgactgaaaccaatgatcctaatcatttacccaataaattaaaatttgcctcattaaatctagggtttatgcatgcttgtggtcatgatggacacatcacaattggtttaggtattgcgtcatggctttcacaaaataaggataaatttaacggtaaagtcaaaattgtctttcagcctgctgaagagggagtgagaggcgcagcagctattgctgcaagtggagtgattgatgatgcggattattttgcctcttcccatattagcttttgtgccaacacaggtactgtcttagcaaatcctcgtaatttcctttccacaaccaaaattgatattcgttataaaggacgacctgcacatgctggtgctgctccacatttaggtcgaaatgcattattagcagcggctaatgccgtaacacaattccatagcattgctcgtcatggtgaggggatgtctcgaattaatgtaggtgtattaaaagcaggtgaagggcgtaatgtgattccgagcagcgcggaaattcaacttgaagtacgtggtgaaaataaagagattaatcaatatatggtggatcaagttatgcaaattgccaaaggcattgcgattagtttcgatgtaagttatgaaactgaaattatgggtgaagcagtggatatgaataatgatcttgagttagttaaattgatcgaggaaattgccattcaacaacctggaatcaatgagtctactgctgattatgcgtttaatgccagcgaagatgcaacgattttagggcgtcgtgtgcaagatcatggtggtaaagcgatttattttattgttggtgctgatcgtacagctgggcatcatgaggcaaacttcgattttgatgaaaatcaattgctgactggggtaaatatttatattggtttagtacagcggttattggggtagtattgagtttttaatttattttcgattaaaaagtgcggtcagtttttcatgagaatgaaaactaccgcacttcttgtctattgaattattaacagttctagcagttttttttgctttcaggtacaatcagccgattaaattttatcttatattaatgaaaaacttttagattttatttttatgaaaaatattcgtaacttttctattattgcacacattgaccatggtaaatcgactctttccgatcgcttaattcagagttgtggcggtctttctgatcgtgaaatggaagctcaagtactagattcaatggatttggagcgtgagcgaggaattactattaaagcacagagcgttactttaaattacagagctaaagatggtgaaacttatcaacttaactttatcgatacaccgggacacgtggatttttcctatgaggtatctcgttctttagcggcttgtgaaggggctttattagtagttgatgctgggcaaggcgtagaagcacaaaccttggcaaactgttataccgccattgaaatggatttggaagttgtacctattttaaacaaaattgatttaccggcggcagaacctgagcgagtcgctgaagaaattgaagatattgttggcattgatgccattgatgcggtgcgttgttcggcgaaaaccggtgtgggtattgaagatgtattagaagaaattgtacgtaagatccctgccccggaaggtgatccgaatgccccgttacaggccttgatcattgattcttggtttgataattatttgggtgttgtatctttagtgcgtgttaaaaacggtattttacgcaaaggcgataaaattaaagttatgtcaacgggtcaatcttataatgttgatcgtcttggtatttttacaccaaaacaagtagatacaacagagctgaaaacaggcgaggtaggttggcttgtttgtgcgattaaagacattttaggggcaccggtgggagatacattaacttcacatcataatccggcaacctctgtgcttccgggatttaaaaaagttaaacctcaagtttatgcagggcttttcccaattagctctgatgattatgaatcatttcgtgatgccttaggtaaactaagtctaaatgatgcgtctttattttatgaacctgaaaattctaccgcacttggcttcggttttcgttgcggttttttaggacttttacacatggagatcattcaagagcgtttagaacgtgaatatgatcttgatttaatcactactgcaccaactgtggtttatgaagtggaacaaaccaatggcgaagtgatttatgtagatagtccagcaaaattacccccactaaacaatattgctgaaattcgtgagccgatcgcagaatgtaatatgcttttgccacaatcttacttaggtaatgttataacactttgtgtagaaaaacgtggagtgcaaacgaacatggtatatcacggtaaccaagtggcactgacttatgaaattccaatgggtgaggtcgtgttggatttctttgatcgccttaaatcaacttctcgtggttacgcctcgttggattatggttttaaacgttttcaagcagccgatatggtgcgtgtggatattatgatcaacggtgaacgagttgatgcgttagctttaattgtacataaagacaatgcacaatatcgtggacgtgaattggtggaaaaaatgcgagaacttatccctcgtcaacaatttgatattgctattcaggcggcgatcggcaaccacattatcgctcgttctactgtaaaacaattgcgtaaaaacgtattggcaaaatgttatgggggagatgtaagtcgtaagaaaaaattgttacaaaaacaaaaagaaggtaaaaaacggatgaaatctttaggtaatgtagaagtccctcaagaagcgtttttagctattttacatgttggtaaagataagtaaggaaacaccaatgtctaaatcaaatttatttttcgttatattaattgcagcgggatatgccatttggaaattacttgatcatttggcactaccgaatacattcaatattttattaattttattgaccgcactttgtggtgttttatggtgctataaccgttttgttatcttgcccaagcggagcagacaaatttctcgtgcagaacagcgtagcggtaaaatattaacggatgaagaaaaaagtaaaattgagccgatttctgaggggagtgaattgttagcttccctatttcctgtattgactttcgtacttattttacgttcttttctttttgaaccgtttcaaatcccatctgtttctatggagccaaccttgcgtgtcggggattttttattggtcaaaaaatatgcctatggcattaaagatccgatttttcaaaacacacttattgaaacgggaaagccgcaacgtggtgatataattgtctttaaagcacctttagaaccaaatattgattatattaagagaatagttggaatatccggagatcgtgttttttatgatgaaaaaacgcgtcatgtgacaattatttataataaagacggcaaagaatgtgtttatgattgtcaaataaaggaatttagttacagcgagccacagcgtaatcctgaatttaccatgatcgttggtaaggatgcacaaggaaaagctatctatggcgatgaaaatcctttggtcttaactgagaaaggcgatgtggaacatcaaattcattgggatccacgcatttttaaccgcacttatatgtacagtggttaccgtcagcaaaaagattacgtaaccgaatggattgtaccggaggggcaatattttgtgttgggtgacaaccgagatcagagtgcagatagtcgtttttggggcttcgttccggaaaaaaatattgtgggtaaagctgaatttatttggttgagtcttgataaaaaacaagatgaatttccaaaaggcattcgtttctcaagaatgtttacctcaattaaatgacaaattattgacttaataaaacgccctttaaattaaagggcgtttctgtgttatgaaaaatccggtaaaagtgcggtagtttagtcgcaaaaaataatatgtctttcttttattttcaaatagattaaataggggtattatgttccattatttttgatgtggaacatcaaatttacgtttcttattgatattcttgaaaaaaattatgcaactggaaaaattacaaaaaaaattaggtcaccaatttactaatcttgattatcttaaacaagcattaacgcatcgaagtgctgctgcatttaataatgaacgtttggaatttctaggtgattccattctaaattttgctattggcaaagcactttacgaaaaatttcctaagtctaatgaaggtgaattaagccggatgcgtgcaacgttggttaaagaacaaactttagctgttgtggctcgccaagttgaattgggtgattacttaaaactaggtgctggagagttaaagagcggtggatttcgccgagaatctattctatctgattgtgttgaagcgttaattgcagcgatttatttagatgcaggaatcgatgttgctttagctcgagtttatcagtggtatcaggaattacttgaacaaataaaaccgggagaggcacaaaaagatcccaaaacacgcttgcaagagtttttgcaagggcatcgcttaaaacttcctgaatatgaagtgatagaaattaagggagatgctcacaatcagtcttttagagtgagctgtaaagtggaaacacttactgacgtcgtttttggacaagggactagtcgccgtaaagcggaacaacatgctgctcaacaagctattgaaaaattgaaaattaaataactatacccgtcgggacaatatttttttgtccttgcataatatgagagaaaaaatgacagaacaagaaacttattgtggttttatcgctattgttggacgtccaaatgtgggtaaatccactttattaaataaaatcttaggacagaaaatttccattacttcacgtaaagcacaaacaacaaggcatcgtatagtcggtattcacactgaaggtgtttatcaagcggtttacgtagatacacctgggttacatattgaagaaaaacgtgcgattaatcgcttgatgaatagagcggcgagtagtgcaattggcgatgttgatctgataatttttgtggttgatggcacacactggaatgacgatgatgagatggtgttgaataaattacgtcgtgcaaaagcacctgtcgtgttagcaattaataaagtggataacattaaaaataaagatgaacttttaccttttattacagacgttagtcaaaagttggagtttaaagaaattatcccaatttctgctcagcgaggtaataatattcacaatttagaaaaaatagtccgcacttctttacgtaaaggagtacaccattttccggaagattatgtaacagatcgctcacaacgctttatggcatctgaaattattcgggagaaattaatgcgttttacaggggaagaattaccctactctgtaacggtggaaattgagcaatttaaacttaatgatcgtggtatttacgaaattaatggcttaattttggttgaacgtgaagggcagaaaaaaatggttatcggggcgaaaggacaaaaattaaaaactatcggtactgaagctcgtcaagacatggaacgtttatttgataataaagttcatcttgaactatgggtaaaagttaaatccggctgggctgatgatgagcgtgcattacgcagtttaggttatatagacgaataaaataaaacattaaggagacaaattatgtacttggaacaagtgaaaactgagttatttgaagcacaagatgtactaaataaatttatcagtaacgaacaaaatatcaagctcattcaacaagccgcattactgatttcagatagttttaaacaacatggtaaggtattatcttgtggtaatggcggttcacattgtgatgcaatgcattttgcagaggaactaacgggacgttatcgtgaaaatcgtccggggtatccggcgatagcaatatcagatgttagccatttaagctgtgtaagcaatgattttggctatgaacatgtattttctcgttatgtagaggctgttgggcaaaagggcgatgtattattaggcatatcaacctcaggtaactcaaaaaatgtattaaatgctattgaagcggcaaaagccaaaggtatgaaagtgattgctctgacggggaaagatggtggaaaaatggcgggacttgcggatgtggaaattcgtgtacctcatttccgttttgcagatcgtattcaagaaattcatattaaagttattcatattctaatcatgttaattgaatttgagatggctaaaattagacagtaattttttaacctttttgtactattacagagaaagattttatgtcatattacaataatgcaatcttccctttgcttttagtgtaaatttagattaaaatcgcaacccttgttttagggtcaataattcgtttattgaacaatattaaattttgcaaaatattaattaatcattgaggtgatggcttatgccagtaattaaagtacgtgaaaacgaatcattcgacgttgcattacgtcgtttcaaacgctcttgtgaaaaagcaggcatcttagcagaagtccgcagtcgtgaattttatgaaaagccgacaactattcgcaaacgtgaaaatgcaacgcgtgctaaacgtcatgcgaaacgtgtggctcgtgaaaatgcacgtaatacacgtttgtactaattaaaaaatttttttaattaaactcgagttaaatagaccgtgaaacctcataggaatcacggttttgtttcttttataaattctctatcatatttgcttttatagtattattaggctagtttattcctatttgatgctattttagggatttatcttttttatgtcaggcaaaataccgcattcatttattgatgatattttagctagaacagatattgtagatctgattgattctagggttaaactcaaaaaacaagggcgagattatcaagcctgttgcccttttcatcatgaaaaaacaccttcttttacggtgagtccgaaaaaacagttttatcactgttttggttgccacgcacatggaaatgcgatctcatttttaatggaatatgataaattagaatttgttgaggcaattgaagaattggcttctttgcatggtttagaagtcccgagagagaaatctacgcttgatgaaaaaacacgagttagttttaaaactaaacgcaatctgtacgaactaatgcaagaaattgcaaaattctatcaagagcaattaacgcaaaatatccccgcacagaattatttacaacagcgtgggttatcaatagaaattattcaacgttttcaaatcggcttttctccacagcaatctagtttttttataaaaaaatttgccacaaatagagaagaaattcagaaattatttgatgtgggaatggtaaataaacgagagagcggtgaattatttgatcgttttcgtcagcgagttacttttcctattcgagatagaagagggagagttattgcttttggggggcgaattattacccaaagtgataatagaccgaaatacttaaactctcctgagagcgtaacttatcataaaggttatgaactttatggtttatttgaagcgttacaaattaatgatagtcctgaaatgttggttatcgttgaaggctatatggatgttgtcgctttagcacaattcggcgttgactatgctgtggcatctttagggacagcaactactactgagcaattacaattagcctttcgttcaacagaacaaattatttgttgttatgacggtgacagagcaggaagagatgcggcttggcgtgctttagaaaatgcacttcctttattggaagatggtaggcaattaaaatttatttttttaccggagaaagaagatcctgatagttttattcgacaatatggcaaagaaggatttgaggattatattcatcaagcacaatcattaagtgaatttttatttaatactttaagtgctaaagttgatttttcctcaacagaaggaaaagccaaattagcttctcttgcaattcctttaattcagaaagtgccgggagaaatgttgcgattgtctttacgtgatatgttcggtcaaaaagtaggcatatttaatccggacaagttagatagattactatccaatcaacaacaggttgaatataaacaaaaaattccgaaaacagtaaaaagaacaccgatgcgagttttaatcgcacttttattacaaaacacaaatttagctaaaattgtccctgatttatctccactaaaagttttacaagagccgggcttggatttatttgaaaaaattgtaatactttgtcgtgaaaatgttggtatacgagctggacaaattttggaacattggcgagacacggaatatagccaagcacttgaaattttagctacgtgggagcatgctgttgatgatgataaaattgagcaagaatttagagaaaccttgattcatctttacaagcagttagtcgataagcgtattgaagaattaattggtcaagaacgtatggttggcttaactaatgatgaaaagatagaattagcacaattattatcgaaaaagcaagaaaagaaatagttaatcttttataagaatggtagaattctccattcttcaatccttattaatcgaggcagatattaaatggaacaaaataaacaatctcagctgaaattgttaattgcacgaggtaaagaacaaggttatttaacttatgccgaagtgaatgatcatcttcctgaagatcttgttgatgctgatcaaattgaagatgtgattcaaatgatcaatgatatgggtattcaagtacttgaaagtgtgcctgatgctgatgacttgatgctcaatgaaaatattacggatgaggatgctgttgaggaagcgactcaagtattatcaagtgtagaggcagagttgggaagaacaacagatcctgtgcgtatgtatatgcgtgaaatgggaagtgttgaacttcttacgcgtgaaggcgaaatcgatattgcaaaacgcatcgaagaagggattaatgaagtacaaagtgccgtagccgcttatcctaaagcactcaattatcttcttgaacagtatactttagttgaagaaggcggtatgcggttggctgatctcattaccggttttgttgatccaaatgcggttgttgaagaagagataattgaagccgacgacatacttacagaagatgatgaagaacatgtagaaagcaatgttgatgtaaacgatgaagaagaggaagaggatagcgaagataatagcaatgtagactctgattcggataacacaattgccccagaagttgctcgtgagaaatttgaagcactaagaatacaacaccaaaaaactttagccgcaatagaaaaatatggtcgttcccgtaaacaagcaaaagatcatattcaagcattagccgatatttttactcagttccgtttagtgcctaaacagttcgatgcgttggtcaattatatgcgtgatatgatgaaatctgttcgtcagcatgaacgacaaattcaaaagctggtagttgatttggctaaaatgccaaaagaaaatttccaaaaattatttattggcaatgaaagttcagagggttggctggataaattactgcttgcaagaaaaccttggtctgaaagattaatacaacatgaaagtgcggttcgtcaaagcataaaccaattattaaaaattgaacaggaaaccaatttaactatttctcaaattcgtgaaatttgtgacaaagtggcacaaggagaattaaaagctcgccgtgcaaaaaaagaaatggttgaagcaaatttacgtttggttatttcaattgcgaagaaatacactaaccgtggattgcaattccttgatctcattcaagaagggaatattggtttaatgaaagcggtagataaatttgaataccggcggggttataaattttcaacctatgcaacttggtggatacgtcaagcgattacacgctctattgcagatcaagcaagaacgatccgcattccagtgcatatgattgaaactatcaataaattaaaccgcatttctcgtcaaatgttacaaaaaatggggcgtgaagccacatctgaagaattagctgaacgaatgggaatgcctgaggataaaattcgtaaagtattaaaaatcgcaaaagagcctatctctatggaaacgcctatcggtgatgacgatgattcccatttaggtgattttattgaagacaatacgttagagctaccgttagattctgcgacagcccaaagtttgcgtgctgcaacgcatgaagtgttggaaggactaaccccaagagaagcaaaagtcttgcgtatgcgttttggtattgatatgaatacagatcataccttggaagaagtcgggaaacaatttgatgtaactcgtgaacgtattcgtcaaattgaagctaaagcattgcgtaaattgcgtcatccaagtcgttctgaaaccctacgcagtttcttagatgagtaaatgatgagagtaaagaaagttatcacgtttttttctcaaatattttggcacgacaaataatcaaaattaacctaaaaaatataatccctattgaaagaaatggctcaatagggatttttcattatgctaaaaagtgcggtgattattcaatcctatttgagcatcaaacatttctaattgttcgcctcaattaagttaggataaaaagtaaaaaaatcgtttctttcctataaaaatttaggataaaataacgagaattttcacttgacaaataaaatagaacggaaaaaatgacagtctacagtctacagtctacagtctacagtctacagtctacagtctacagtctacagtctacagtctagtatattgcctaaaatcaacctttcaagttaattttgagaggttggacatgttcaaacaatatcttaaaaatcacctatttcaacctcaacctttcggcgaaagtattattcgcctttttctgctttgtcttaaaaagcaaggtatcgcctatttaggtttataacctatctctctaaagtttaataaataatcagtaagagataataaataaacaataacagattcgatcaataaccacttaataagtaattaacagataatttttaaagcgagtaaagaatatgaacaaaatcttcaaaaccaaatacgatgtaaccactggacaaaccaaagtggtgtctgaattggcaagcaatcgccaaatagcgagcagttcgaagagtaaaccgaagtgcggtgcgttttggggtaattttttaggcatttttaaattttcaccgttggcgttgttgatgtcggggatgcttggtgtgagcagtgtttcatatgctgatatagtatatatagatatggaagcaactacaggtgctgctggagtaagagaaaaatggcatttgtcaagttattggaaaaatattggacgtgaaaatattttaatagcacctgttcaacctaatagaaataatcaaaatttaaataggtatggtagtagaataaatacaaatgtacaaaaatctgtaatcataggtcctatggcggcaggtagagatgagcaagttggtatgactgtattaggtcatggtgcagtcggttatagtagtcaaacaactgcgattgggaataatgtctatgctggaggcgggcaagccacagcgataggttcagatgttatggcagcaggttacgcttcgattgctataggtaatgatgatatcttgagccaaggtggatacgccgacgcattaccgcaagatcttattatgaaaatttatgggtatgatggaaatcataacggaaaaactacttataaggacatattagacagagatatatttgtagataaatatgggaaaaaacctaatcaagatcatagacactattctccaacttattcagccggaataggtgcaatagctattggttcaagatcggttgcttatggggatacttcacttgctttagggactttatcatttgctttagctaaaggctcaaccgctgttggtgttcgtgcttttgtgagtgaagatgcagaaggtggggttgcgataggggatgagtcaagagtttttgctgctaactcatttgctataggaaatgaagccgaagcaactaggaaaggggcaatatcttatggttctggctcaaaagcagtaggagaaggatccatcgcaataggtaccaaagtagcttctaatgctaagatagatgaggcttcagctcaaaaatttagaaccaaacttatgcaagaactaggtattggaacgattcgggaagataaacaaaaagatgttaatacaataataacaactgaagttacagatcttaaaactggaaatcagaatgagattgttaaatctgggtttgctaatcatttagacgataaaaaaattaacgataagattagtaaggttattactggattagatttagaatatcaagaagaaggaaatgagtttttatcaacaacgactgatggcaagaaaaaatcaataaaaaagaaagcaaaagaggggcaacatgctgtaactataggttattacactattaataatggagataataccgtagccataggcacagcttcctatgtaaaaggtcaaaattctgtcgttttaggggcattaaataatgtcggacaatatgcaagtaatacgatagcgattggggttgggacaaatgtacataaagaaaactcaatcgctttaggaacgggcacaacagtaacaggtgcgggcgttgtggctatcggttccggcgttggtgtaacaaaagacaatacaatagctatgggttatggagccttaggagaatcaagtgaaagcatcgttttaggaaatagtgccagtataaaggatcaagcaaagaaatctatagttattggtaatggtgcaaaagttgaaaatcaagatcctgaaaaagacagtaaattaacgaagttaaaatggtcgacaattggagatgataggcataaagtagaactagaaatgtccgctattgctatagggacaggttcatctgtttatgctgtaaagggcgtggcattaggagataacgcaagtattggaaaagatgctcatagttcaatggctttaggcaatgaaaccaaagcagatatgatgaactctgtcgccttgggctatcgctccaccaccaattatttttatgataaaaacgatgccaataaatctaccgctgttttgagtggaaaagacagtctaagtgcgatggaattggacggctatgtgccggaaggatctagctataaaattttcaatgataaagctgctgggattatttctgtgggtggttgggataacggaagtgcttcccgtgctataggcgatgcgaaaaaaagtgcggtcggtttacgtcggattgtcaatgtggcaccgggtgctttggactctgacgtggcgaccgtggggcaattaaaagccttgaactacgtcaaaaaagaaggtttggtggtttattacacagttaaagatgatggtaaagtcattaaactgaccaaagattctaatggtaaattctatgaagtcaacactgcaaccggtgaaccgttgaaagattctcaacctgtcgataaaagcaaagtcttagtcggggcgaaaggggcgaatgaggtgattggttcgcaagatcttggcgaaaaaatccgcttcgggcatttagagaaaggggagattactgcgacttctgatcaggcgattactggggcacaacttgatgaccttaaaggtaagttggggttgacggtaaataaagatgatccaacaaaatttgataaagtccaatttgacgcagtaaatgtaaccgattcaagtgatacatcaggagtaataacaacttttgaagatgctatccgtaaaagtattgcagctatcaatagaggctataaatttgatgatggaactaataatcctaagactaaagatacacctttttatttaggttcaaccattgtaatcaaagcaggggatgttacaaagtcaggtaaaacgacagagaactatctaggcaaaaacctaaaaacagaatttaaaaacgatagttcaaaagcgacattcaccatcggcttgaaagacgatcctgaatttaaatctgtaaagattgacacgattgaggataaagaaactactgataaaaaacttgccgtcaacaaagagtatgtggataacaaacttaaaaatgtctcgaccgatttacattatttatcggtaaaaggtagcgataaaggcaatggttcaaattacaacaacgatggagcaaaaggcactcattctgtcgctattggggtgaaagcaagtgctacagcaagtgcgacgtctggtattgcgatagggtataacgctaaatctgacgcagaaaatgcggttgtgataggtagagatgttagcattgatgtaaaaaattcatttgtgctagggtctaataatacagttacgcaaggctttaaagagacaaatggtgcggttgttgtaataggtagtggaacaaaattagtagaatcaaaaagttctatcgctataggtgcggtttatgtaaaaggtaaaaacggagcagatggcactttaattgaaaacgctgcttggacagcctctatcgggaataaaaacaaaatcaaaaacggtacggatattgtggcgttaggtaataatatccaagcattggataagacagatgaaatgtctagtaatggaacaaagaatgcgaatacagatttaattctgattggtaatggtgcgatagctgaaactgcaaaagaaagtgtgcttattggggcaaaatcaaaagctgaaacgggtgcaaaaagtgcggtaattatcggtcatagtgctaaagctgagagagacgccgttggtgcagtagcgattgggaaaggggctatagtaaaaaccgccgcaggggattccattgccttgggacaagggtcagaagcgactaaaaaagaaaccgcacttcatgaagctaaaatagagactattaatgttaaatttaatttcaaaggtggagtgagtgctgatgataaagaaaacaataaaaaatccgttttaagcataggtaaaaccggcaaggaaagacaaatcaaacacgtcgccgcaggtgcggtaacggaaacttcaaccgacgctatcaacggaagccaactttacgctgtcgctgatgagttttctaaattagcggtgaatgtattgggtgcggaagttgatacaactagcggatttaagaaatcagaatttaccgttgttcaatatcatggaagtacaaatacaccagcacaaaaagaaatgacctttaaagatgccattggtcaaaatacaacagcgattaataaaggctttatttttggaagcgaagatgatgctaaaggaacacattatttaggagataagttgataattaaagctggagctgtagatacaccatctactattacagcaggagaaaaatatcttcctgataatattaaaacaaagtacttatcaaacagtaaagaattattaataggcataaaagaatcccctacttttaaaaatgtattaattacagaagaaattcctgaggataagtcaactgatcctaagaaaaatacttatgataactacgctgtcaacaaaaaatatttagacaaaagattagaaaaagtcgccgctaatttcacggttaagggtgataatcctaaagatggaaaaggttataccttagataaagagcataatgaattaaatattaatggagatagtgaaaatatcacaaccgcagttgttgataataaaggaataaaaatatctcttaacaaagaattaaaaggtattacttcaattgctaataatgatacaaaaattgaattaaacaatggaactggtggaaatggaacaaaatctatcgttttcaccgctggaaattcagataagaaagtaacattaactgaagataaattcagtggtgtgtctgaaattagcagtaaagacagtcaatctaaattaatacttggtgctgataaagcaactgtagaattagaacatggcaaatcaaaacttgaactaaaagatactgaagcaacaattacagcaggaactgatgctggaagtattaaaattaacaataacggtaataagaaaatcgagttaagccctgaaagtggagcgacattaacacttgcaaaagataacagctctagcaatgttaaagctaccggtttatcgactgttgggttaagtgatgataacgctttaatctttaaaaataatggtagtaaatctgcggagttgaacgtaggcactaatacaacctataaattcactgaaactggattagatttagctggcaaaccaatcacaaatctaggaagtggattagatcaaaatggtagtggtggtactaatgtaagacaaggcttagacgagttgttaaaacttattgatagcacacaaacaggtacacaaaatcaaaatagcgataaattaaacaaagccatcaatgcaggcgatttgcttcatgtcgctcaaggcttggtgaataaaggcttgacgtttaaaggtaatgctggcaatgaatttactcgtcaacttggtgcaacagtaaccattaaaggcgacggaacggatctaacatcaaaagccgaaactgatgctattacctttactttaaataaagcaacttctgtagataaaaatgacgaaaaagtcgttacctcaaaagccgtagcaaaggagttggaaaaatataccaagactactgatttagttgataagttaggcacggcgtatttaaaagtagatggatcgaatattggcgaggcttccaataaaaaaacattcggtagcaatgtcggtattgctgaaatcaagttagatggtgaaaaaagcagtactgaattagtacaggcggatgcggttattaagtatctaaaaggtactaaaaatggctctgtgaaaatttctgattcaccggaaactaaagctgatggggataattcaatcagtataggtctgaaagccgttacacaaaatgccgactccattgcaattggctataacacaagtgctacaaatcgcaagtcattggtgttaggtagtgatagtactgtggacggcgaagagtctgtagcaatcggttcaacgaataccgtgagtagtaaatattcaggggtattaggaaaaagaaacaccgttagcggagagcatgcttatgtattgggtgcttataatgaaatcaagggagaaaacacttatgtcttgggttcaaatattacgacaactaaagatataacaaatgctgttatcttaggtaatagatcaacaggtgtatccaatgcggtatctgtaggtagcaaagatgaacaaagaagaattgtttatgttgccacaccaacggataaatacgatgcggtgaataaacaatatgttgatggacttggattaaaattcaaaggtaatgataataaagaaatacacaaaaaattatcagaaacattagaaatagttggtaagggtttaaataaaaaccaaactgctaaatttaaaggcacagatggaaatattgcggttataaataataagcaaaataaattggaaatatcattaaatagagatttaaaaggaattaaatctattagtgatagcaagaataaaaatatagctactgaaataagattcaatagaaaaaatgacacaaacagtattcctaacagtctgacaaataacttaactatttcttcaaatggaggcacatttgaatttaatagaacaggcttgcatatcaacaacaaacaaattacagggttaagaagtggactattagaaaaccataatggaaaagatcaagaaagaaaagatttagactatttaataggaaaagactttgatacttcatcgattaaaacgcatgcagttaatgtaggagatttagctaaaatttctaaagaaatagttgaaaaaggatataagtataaagctgatatgccgtcaggtaatagcaatgataccagcataaaactaggctcaaccatatctattgtaaaatggacagacacaccggcatcagggactggacaaccagcagtaactgttggcacaggaacaacttctcaaacacaagctgttaagtacacaggagataatttaacaactcgatatacctatgacggtggcaacgctaagatagaaattggatttaacgaaagtccgacatttaaagctgttatgcttgctgaaaatcaaacatataatggcggaaatgcagttgatggcaaagaactcatcactaaaggctaccttgaacaagcgttagataagtttaagttcaaggttgaaaatggtagcggtaagcctatagaaatcggtcgtggcgatacgttgaagtttaaggctggcttgaatattcaattaacgttagctaaagagggtgaaaaaccggcaaatggggcaacgtctgaaagtagcacaagtgaggtaacttctaccccagctccgaccgctccagccgtggcaagtagttcagacagttctgaaccagcaagcacgtcatcaggtagtgcaggtggtgcggttgcgtcaggtggtacaaatggcgatagtgcagatactgtggtcgcttcaagctctccaactgcgggaacttcaagcacaacaacgagcacgccaagcgatacgagtacaccaaccactactacaccaataacggcagtggtaaccattggcacgactgaggatttgaaaaatatcacctcgatttcctctaaagctggaagtacgggcggaagtggtgcaaatggtgcaactggagaagtgacgaaacttacgttagatccgactaagggggcgactttccaagtgggcaatcaaggtgctaaagtcaatattgataataagggcatgacattcactccacaaggagcgaatggtgcagatggggcgaataactcaaatgctgacacgccatctattactattaacgcaggtacaaaaccggcagatcaaagtggtctagaatcgtttgagaaagatcaaggtccatctattgcgttctccacaaaaaatactgacggtaagaaaatcggctcaggcaaaatcaccggtcttgctgatattaaaccggaggaaacagacggcacccttgcagcgaataaaaactatgtggatgaaaaagtatccgacttaaacaataatcgcccgtttgatttttatttaggcaatgaaaaagtcgtgaaaggggctgatggcagtttccacaaagacggtaaacctagtgaaaaactttctgaggaagagaagaaacaagtcgtgattaaagccgaaccaagcacctcacctatcgggattagcaatgtggcgagcggtttgggattagctgcccctgaaaaagacatggctaaagcggaagaagcgaaacaaaaaaccgcagaattggcaaaagcggttgagggtaaggtgaaagatgtcggtgataaagccaaaacactatcccaaaaagcacaaactttcacggatttagcgttagcggtgaatagcttagaacaggcgataaatgcgttgccagaaggcgaggataaaaagctggcagaaactaagttacaagaaagcaaaacgaagcttgatgaggctaaaaaagagcttgaaacagcaaaaactgctttaactgaagctcaaaaaggcttaacaaatgccaataacgcctatgaacaaaattacaaaggctatgaaaaagtcgctgacttagtcagtgccgatagtaaagccgaattaaccaacgtagccacaaccggcgatttgcaagcggtggcgaaatccggcatgaagttcaagggtaatgacggcatggaagttcgcacgccattaagcggtaccttggtgatcacgggcgagggcgacacatttaacagcgacctcaccgccgtcggtaatatcaaagtggaaatgtcccaagacggcaaaggcttagaagtgaaattgtctgatcaattgaaaaatatgacgtcttttgaaacccgtgaagtgaacggtaagaaagcccgcttggacagcaacggtttgagtgtggaaaatacaagcacaaaagaacgctctcatttaagcgaaaaccgtttggcgttctatgatgaaaaaggattgggattgaatttagatggcaaagatcgagccttaaaagtgggtgaaaaagcgattattagcatcaacggcaaaaatgaggctttagttgaagatctcaatgcttctagttcaggtcaggcaattgcgaataaaaactatgtggacgcaaaaaataatgaattgcgtacacagcttcatagtgttaatcgtgaatcacgttcaggaattgctggtgcaaatgcggcagctgcgttgccaatgattacgatgccaggtaaatcagcactttctgtctctgcgggggcttataaggggcaaagtgcggtggctttgggctactctcgtatgagcgataacggtaagattatgttgaaactacacggcaacagtacctcaaccggcgattttggtggcggtgtcggtattggctgggcatggtaagtaacgccctttgagctaaaaaagcagtgaatgatgatctgctccttaatcagttggttgtttagtccaacttttgggtgcagatcggaatcactgcttttttgatgcggatttactatgatactttttaatggtgatggaactgtaatatcatcaccagcccagtattagtcttaggtgaaagcggttagaatacattaacttctgtccttgaaaaagaaatattcattgagggtgatagaagaaattcactgatgtattaggggagttagtaggaatttcgttttttagagagaggagaacatcaatatatgaaatattcgtttatttcataatgaatcggcatataatgtcaacctttcatgttaaataaaggattcgcattatggaattttctgtttatctacaattttttattgggttaattgcgttggttaatccaattggggttgttcctatcttttatacgatgacatctggtcaaagtcgtgttcagcaaagtcatactgctatgattacttgtttttcgattgtcgttattttattgatcagtttttatttcggtaatttcattttaagttcgttcaatatatcgattaattcattcagaattgccggcggtattgtcgttgtgatgatagctttaactatgattaatggaaaaattggtgatcacaaaattaataaagaggaacaaaaagaggattttagcgaaaaagataatattgcagtcgttccgttagctatgccaattttagcgggtcctggatcaattagtgctactattgttctaggttctagtcagagttcatggagcgaatacttatattcatctattacaatcgcactttttggtttaacttgttatattttatttcgttattcagagccagttatagaaaaattaggtaagacaggatcaaatgtaataacaaggattatggggttattgctaatgtctttaggtgtagaaattatcactaccggcttaaaaaatataggcgttttttagcttcaaagtcatattatccggtaaaaaatacaccgcacttttttatgctaaacattgttttttttcagtataataaaaaacgttttttcacaacaatgatggaacaataattatgataaatacaaaatttaatgtaagaacctttcaggggatgattcttgccttgcaagatttttgggcaagcaaaggttgttccgtagttcagccttttgatatggaagtaggtgcggggacatcgcatccaatgacttgtttacgtgctttgggacctgagccgatggcatttgcctatgtacaaccctcccgacgtccaactgacggtcgttatggtgaaaacccgaaccgtttacagcattattatcaattccaagtggtgatcaaaccctctccggataacattcaagaactttatttagacagcttaaaaatgctcggtttcgatccaacccaaaatgacattcgttttgtagaagataactgggaaaatccaacacttggtgcatggggtttgggctgggaagtatggctgaacggaatggaagtaacacaattcacctacttccaacaggtcggaggcttggaatgtaaaccggtaactggtgaaataacctatggcttagagcgtttggcgatgtatattcaaggtgtggacagtgtatatgatttggtatggtctgacggtgaatttggcaaaactacttatggcgatgtattccatcaaaacgaagtagagcagtctacctataatttcgaatatgcagatgtaaatttcttgttccattgtttcgaacagtacgaaaaagaagctcaatacctgatcggtttggaaaaaccgctaccacttcccgcctacgagcgtattttaaaagcagcacacagctttaacctgcttgatgcacgcaaagcgatttctgtcactgaacgccaacgctacatcttgcgtattcgtgctttaaccaaaggtgtagcggaagcctattatgccagccgtgaagcattaggatttccggggtgtaaaaaataatgacaaaaccgattttatatttcgcccactggtgccctgataccgaaccgtttgtcgctgaactagaacgcttgggtgtggaatttgaagagtgcgacatcacaaagtgcggtgcaaatcttaaactttttttacgtcttcgtgactaccacccagcctttaatcacgccaaagccaaaggctatataggtattccggcattgttgttagaaggggataaagtggtgttggatttagctgagttggaggggatttggggtaacgtatagtagaaatattgctcggttattgaaaaaataaccgagaaatttatgttacagatttagaaattatcataatcaaggagaaaaaatgaaatacgcctttatcgactatgaaaacctgaattcattagatggtttagcattacaagagtatgatcgaatttttctctttatttattccaacatttaaacgctgcataatctaatttttttcatttagacggttgcattggattatctgatgtgtataatagaaatcaaataatcgtgtttaacggtttggtctggaaacttcaacgttaaaacacttgtaacggataagccctatagccaaatagggctttttctttatctgtaccttttagcttagggatagttaccgacaggcgaaaccgccgtttacggcggttgagtttttagagctgaagcaaggcagaaatgccgtagcctgaagcctaaaaatatagcccgaccgcacgcttttgcgtggggtaagcccctaaaccatataaactggttgctattgtaccgcctgacttatacaaagatcaagtaagatctaaaatccacgcaaaaaaaattttttacttatctactaagattgctaaaatatatatgctttcaaagctgattagccttgtatttttacctttaaacatacaaatctacaatatacaatttacttttaaacaaggagagagtaaaatgtcatcaaatggttcaacaagtttacgagtttcaggtgcaagaaagagaattgcggaatctctcgcccttgaaataagtattcaatgtggaaaagtgatcaaagtaagcgatgttctcaattttgttcttgatagatatttaaacacggaaatggtagatgatttcattgagaagtggaaaattgaacaagaaaaagaaattgctttacaatccaaacgaaaaactagaaaaaagagaggtaacgccgatgaaacttaaaacattagcaatgtcagctttattagcttttggtttagttgcgtgcaacgatgcaaaagattatagcggtacatatactcaaataaataaccctaaaatttcgttcatttttgaaaaaggtaaaaatggagactatcaagcaacttttgctaccattttaggaaaaaatagtcttactggtattgttaaaaatggggttttttatagaacgtctgataatgaaaaagtaggcgaattcaaagaaaatcagtttattgacacaagcggaagcctgtataagaaataaattttagcaaggtaaatctctttttttattcataaaaaaagagcctttaacagtatatatactgttgcgtgatttgtcaataactaattgatttacaagggttatttttaattatggcaatcataacaacacaagtattattctctctttttgctcaatgtgctgctaatgtagctcctgagaccttacattttatccaatgatcagggctatgatggtatttgtaactttattcaacataaaaaacaggggcggatttgtcatggaacaaacggcaactagaaattttccagtaagattggaaagcttaaaaaacaatattcgtagccgttgcggtttaaataatattgatataaaagaggctgaaaaattggttgttctagtaattgataaattgctttcagaaaaagtaataaaaattgctgataacaaagtaagctatcctaagcgatagcaaagagtgaatttttattatttatgccactttcttttaagcagaaagtggctaaaaatttaaatactcggattgaatttttctatcaaaatgcgagctgacattctgtattacatgaagatctacatcacaattaaaccaagtttattattttgtcatgtcgttaggaaaatgatgatgagcgtaaactggcaaaagcaatatccgccgcttgtaaagtgcggtcaatatctgcgtcagtgtgtgctaatgacatgaaacctgcttcaaatgcagatggtgcaagataaacaccttgttctaacattttgtggaaaaataaattaaacctttcaatatcacattgaattgcttgttggtaagaggtaacttcattttgtgttgtaaagaagatgccaaacattccgcctacataattgactacaagcgggatattatgttgatttgctaagttttttaaacctaatgccaatttttttgtgagcattgctaaacgttgttcgttaccttcttttttcaattcatttaagcatgcgattccggcagacatagcaattggatttcctgataatgttcctgcttgatatacgggacctgtaggtgcaatatattgcataatttcttttttgcctccgaaagcaccaacgggcatacctcctccaatgacttttcctaatgttgttagatcaggtgtcacttcatagtaagattgtgcaccgcctaaggctacacgaaatcctgtcatgacctcatcaataataaatagagaaccatattcattgcaaagttgacgcaagccttgtaaaaaatcctgtttcggaaggatgcagttcatgttacctgcaacaggctcaacgataacgcaggcgatctgatcaggatattgttcaaaagcatttttgacagattgaagattattatattcgcaagtgatggtatgtttagcaaagtcttccggaacaccgggagagcttggttgtcccaaagtcaaagatccggagccggctttgacaagcaaactatccgagtgaccatgataacagccttcaaattttaaaattttatctcttttagtatagcctctagccaaacgaatagctgacatagttgcctctgttcccgaattgaccattctcaccatttcaattgatgggactaattgacaaattagttccgcaagttcaatttcaagcggtgtaggtgttccaaaacttagcccattttctgctatttttagtaccgcacttaagattgatgggtggttatgacctaaaatcattggtccccaagaacctacgtagtcaatatattgttttccttctatatcgaaaatatacgcaccgttggctttttctatgaacactggcgttccgcccacacctttaaatgctctaactggagagtttactccgcctggaataacttgttgtgcacgatagaataatgtcgctgaagttgtcatgataaatcctttaatatattgttaaaaacacactttgtattctactgtaaatgaagataaatttataaaaatatttataatacgaggtttttagatgttcttttacattatttattatgcacccaattgctcaacaaattgaattagttggtaaacacattatcgtaagcattattaaggtgcaattcttccttatttcgtaacgaattttgtcattccgttgggctaagagaatgaaaaaagaacgcagagaataaaatcatgaaatgtaatatcacttcataaattttattaaaaaaacgtcagtttggataaaaaattatctaataataaaaaaaagtaaaaaaatgctagacaagtaattgtgaaactcttaatatacgccccgcaacgacgcgatgagcgctcgtagctcagttggatagagcgttggcctccggagccaaaggtcgcaggttcaaatcctgtcgagcgtgccaggcgacgttatatcaaatgtggtggctatagctcagttggtagagccccggattgtgattccggttgtcgtgggttcaagtcccattagccaccccaattagtcggcgagtagcgcagcttggtagcgcaactggtttgggaccagtgggtcgtaggttcaaatcctatctcgccgaccatttttgttctttaacaaactatcagacaaactgtgtgggcacttgtgagactgtattaataagagattaaaagagtaagataagtgcttaaactagagaaattcatagagaaaagatggatgaaatagtcagtatttattgagcgaagagattaaaatgaagagtttgatcatggctcagattgaacgctggcggcaggcttaacacatgcaagtcgaacggtaacggggagggagaatactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtaatacggagggtgcgagcgttaatcggaatgactgggcgtaaagggcacgcaggtggtgacttaagtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccagttgtttcgccagaagcattgctgggtagctaaatgcgggagagataagtgctgaaagcatctaagcacgaaacttgccttaagatgagttctccctaatgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaagctaacaaaacaagtttttttgcgactatagctcagttggttagagcaccaccttgacatggtgggggtcactggttcgagtccagctagtcgcaccaaatgaataaatcaatgtaacgcatagtaacgcatttcaacccaaaagccttgtataacaaggcttttttgctatccgattaacgctagttgcgtcaggataaatcacattgaccttgaataatagcacccattttagtacccacgcattataattagtttgattattgagtactaaaattatacaacctcttacaaatacacaagtagaaaaggcaaagtatataacaggaaacagggcagaactaaacgactgtgaaggcttatttttacagctatacccatccgtctcaaaaatttggcgatttcgctataatcaccctgtaacacaaaaaagaacaaagctaaccataggtaactaccctgatttttctattgctcaagcaagagcaaaaagagaagagtttaaagcattattagcataatacatagatccacaggcatataacgagcaacatagaacagagcaagaacagagcaaaaaaaggacgcttttagcaattgccgagtaatggaaagataaaagcgtgaaagagatagaacctctaacaatggctaaaaattgggagcgattaaataatcattggggctgtattagatcagccctaaattccacaccattttcgcaatgtttttaactgctcttttggtgttccaaagttaaaccgaaattcacattccttcaagaacaaaggaaagttttttcggtcaattccattatattttcggagtatccgtttggcttgactccaaaagttttctataccgttgatgtgattttctttcactgcaaacaactccgaatgattgatgcgttcgtggtgaaattggctcacatcaagagcatcatagctacgatatgtatcggtataaacccaactgtcaggcttgattttccttgtgattacaggcattatcgtttcggttttggtattttctaccaccaccgtaaatacctttccctgtcgttttaacaagccaaaaacagccactttaccggttgctccacgccctcgttttcctttacgatgaccaccaaaatagctttcatcaagctcaatctgtccatcaaaaacatcatcggcttcaagggctaaatgatagctgatgacttcacgaattttacgataaaacaaggcacttgaatttggattgatacctaaaatattagctgctgatcgagctgtcacttctaacacaaaaaactcaaggagctttttctgtatagatttctttaatttacaatgagttattttcatttttatagactagcatacttactaatctaatacagcccctaatcatttatttcctcatttgggggcttactcaatagagaatattacccccccttttttttttactaattaatgctgtcaagcctctttacgagcaaggtaaaaatggcactatgcaccgcattataaatttagttaatcaagtattaaattacgctgttaatttgggtgttttatcatttaatccttgcctacaagctagcaaagcatatcacaaagaactaccaaaaaaatcaccctgctattcattattctgaacttcccctattattggctgattttgaacaatctaacagagagctattaactaaatttttatttaggtggtaattgttatcaatggtacgccctgctgccgaagctgtttcagtggaatggagtgaaattgatttaaataaaaaatttggtttattatttctaaagaaaaaatgaagaaggttagaacggggagattttcgcattctgtacccttatcaagacaaatgataaaatattttagagcaattgaaaccaataacgggacatcataaatatgtatttccatcattcacaaaacctaatcaaacaatgagtaaagacacaattgctaatgcgttgcgtgaaataggctatcaaggtaaacaagacgcccacggattaaggacgattgcaagaacttatttagaagacaatatgattgattttagacttgctgaaagttgtttagctcacaagataggggataaggttagtcaggtctataaccgtgctgactacatcgaacagcgtcgcccaattatgcaactttgggggtatgtgcaccagaattttttaatcaatcaaattgacagtaaaacctagaaaaatcaatgtttctaggttttttatttatcaatatcatatgaatatcgattcattctacttattttggcaatactaacgaggatgatatagtagttgtggtcagtcctctgagtaaagctgagtaaaggcaaaatatgaattattttcatagtcttggcaaaaaatctcatttttcttaaaaaatttttatggtttaatacaccattattctaaaaatgagaaaaattaatatgatgacaacatttgaatgccgtgtacatacgcttgaatttgatgaaaattaccaaccagaaatgcagagtacccgtttaacgaccaactttgctaaccttgcgcgtggcgaaaaccgcaaagaaaatttgcaaaatgtcattgcaatgattgataagcgttttaacgatttggcaaactgggataatccaactaatgatcgttattctgtgaagttagagatcgtgtcaatagatattgatatggagggaaaaggtaatttttttccagcacttgaatggctgaaaacctatgtcatcgaccataaaactggcaaaaaaattgatggtatcgtaggcaacaatttttcgtctttcgtgcgtgactatgatttcagcgttttgttgttagagcataacagaaacaaggaagaatttactgtaccgaaaggctatggtgaattgcatggcaagctattcaaacatctgttaacttcctctgcatataaagaaaaatatagtaagcctccggtgatttgtttaagtgttgcaactactcgtacttaccgcagaaccacaaatgttcatccgattttaggggtggaatatcatcaagataattattctttaactgatgagtattttgcgaaaatggggttatctgtgcgttattttatgccaccaaaatctgttgcaccttatgcgttttattttgatagtaattcagatttgttgaatgattacaccaatcttgaattgattagtacaattgctacaatggaagctttccagaaaatctaccgtccagaaatttacaatgctaattctgtggctggtcaagtgtataaaggtagcttgacttatcaagattactctgtgaccaaagtagaatatgatcgtgttgagcgtacacagcttgcaatcaaacaaggtaaatatactgaagcacattttattaagccatataaagcaattttagatgcctggatggctgaaaaataaatcaagacagtatttttatttgatacattcgtagggtgggttaaattccgcccctacacatttatttaggaaaaccaaaatgagcaaaattcttctcccaacctctacagccggtagtcttccaaaaccggtgtggcttgctgaacctgaaaaactttggtctgaatggaaatatcagggcgatgaactttttcaagctaaaagagatgcactattagtttcccttgctgaacaagttgcagcagggattgatattatcagcgatggtgaacaaactcgtcagcactttgtgactacatttattgagcatttagagggcgtagatttcaataagcgtaaaacagtgcgtatccgtaaccgctatgatgcaaacgtaccaagcgtaattggtgaagtttctcgtccaagctccgtatttgtagacgatgcaaaattcttacgcaagcatactgataagccgattaaatgggcattacccggtccaatgacaatgatagatacattatatgatgcacattacaaaagtcgtgaaaagttagcatgggaatttgccaaaattttaaatgaagaagcgaaagagctggaagcagcaggtgtagacattattcagtttgacgaacccgcgttcaatgtattctttgacgaattgaatgattggggcgtggcagcattggaacgtgcagcggaaggattaaaatgtgaaactgcggtgcatatttgttacggttatggaattaaagcaaatactgattggaaacagactctcggcagtgaatggcgacaatatgaagaaagcttcccgaaattgcaacaatcgaaaattgacattatttctttagagtgccaaaattcttgtgtacctatggaactgattgagctggtgagaggtaaaaaagtgatgcttggtgcgattgatgtagcaaccaatatcatagaaacacctgaacaagtagcggatattttgcgtaaagcactacaatttgtagacgcaaaaaatctttatccttgtactaactgcggtatggcaccgctctcacgtcaagttgcaaacagcaagctcaatgcgttaagtcaaggtgcggcaattattcgagcagaattagcaggttaatctgatatggtagaagtctctcaatttaaagatgcaatggcacaacttgcctcagcagttcatattgtgaccacaagtggtgaaacagggcagcatggctttacagcatcagccgtttgtagcgtgaccgattcaccgccaacattgcttgtgtgtgtcaatagcaatgcacgtgcctatgagcattttataaaaaatagggtgctaatggtgaatactttgactgccgaacaatcttctttatcaaatgtattcgcctcacccttaagtcaagaagagcgatttgctaatgcttattggacaacattggctacaggctcgccgatgttacaggatgcactgattaattttgattgcgaaattacagatattaagcaagtcggtactcacagtattttgatttgtgaaattgtagctattaaacaaggtgataagaaagaagcgttggtatatcacaatcgttcttaccgcattcttaaatgaaatttgtaaataaatcgtaagtcttataccgtaacttataagtcgataagttacggtgttaatttgaaaaaatcgctatgattttattaactttcttagaaaatatttgaaacgattgtatgtacgtctataaagtaattgttctcttttttgatgtttaaccaatagttgactgttatgtagttctttttctaatagagctagtgagaagagttggtaactttgttctaaatattgcattgcttccaatttatattgccttcttctatttaacttgaaatcagacaatgtagtattcggcatttgagtataagataatattttatgtaaagggatgagttctaaattgaataaaaatgagatagtttttggcaaataaacagaatgtttattttgttgtaactcatagttaccaatcccaaaatctgctttcataaattttaagtggtaataggcgaaaatattttttctaatatttctttgactaatgtctaaaaattctgtttccttgttttttttaaagatgctatcttcatctactctaaataaacatagatcaccatataatccacaataaggtgagctgtaagaaatataaagttcaccacaatgatcaataatattaattcctgaaacaggtaatacatcattgggataattttcttttaagtctaggtaagtctgttttagcaacggtattttttctgcacaaagaattaaatctccgtctatttttatagcccatttcttcgtagtttgacttaatgaaaagttatagtaattaatcagactatgaggattatcaggttctaaatttttatagttatcactaccttgaggataaacaacaggtaaatagtgaaaagtttttattttattaggataaagttttgcgtattgttcagcaatttcacccgtattgtcttggcaattattatagacaatcaccaattcatctaataaaggaagccagctttcaatagattgagcaagaaactctccttcattacgtaatcgcataaaaccgcttaagccttcagaacgagtgttggcttgaaaacgtgaaaaatcaatggtaggatttttgactgactgactgactgactgactgactgactgactgactgactgactgactgactgactgactgactgactgactgactgactgactgactgactgactgactgactgactgatttagcatattgttatttccggtctttttagagagaaaaatggtggataatttccaccatttttcaatattattcacttctagtgactttaatcgccaactcttccaaagctttttcattagcaagactcggtgcgtcagtcattaaacaagctgcggctgttgttttcgggaatgcgataacatcacgaatattatctgttccggttaacaacatcgttaaacgatctaagccgaatgctaaacctgcatgtggaggcgtgccgaattttaaggcatcaagcaagaatccaaatttctcacgctgttgatcttcatcaatgcctaaaatatgaaatacagtttgttgcatttttggatcgaaaatacgcactgagccaccacctacttcataaccattaatgaccatatcataggcgtttgccaccgcacttgtcggatttgcttctaattgctccggtgtgaaatcttttggactagtgaacggatggtgcattgcagctaaattaccttcttcatcacgttcaaacattgggaaatcaataacccaaagaggtttccactcatctaagtgagttaaacctaaatcacgacctagtttcaatcgtaacgctcccattgcgtcagtagcggtttgccatttgtccgctccaaagaacaaaatatcatcgctctgggcagaagtgcggtcaaaaattgctttgattttttctgtcgttaagaattttgcaattggactttgtacgccttctaatccagcgttgatgtcattaatttttacccaagctaaccctttcgcaccgtaaataccgacaaattgagtatattcgtcaatttgttttcgagtgatatttataccgtttggtacacggatgacagccacacgaccgttcgagctatttgcagggtcgctgaaaacgttgaaatctatatctttcacaatatcagctacatcgactatttctaatggattacgtaaatccggtttatctgaaccaaagcgttccattgcctcttgccaagtcattgtcggaaatttgcctaaatcaacgcctatggtatttagccataaaccatgcaccattttttccataatttcacgtacttccggtgcagtcataaaggaagtttccacatcaatttgagtaaattccggctgacgatctgcacgcaaatcttcatcacggaaacacttcacaatttggtaatagcgatcaaaaccggacatcatcaatagttgcttaaacaactgtggtgattgcggcaaagcataaaacttgcctttatgtactcgacttggaactaaatagtctcgtgcaccttcaggcgtagccttggtaagcattggggtttcaatgtctaaaaaaccgttttcatccatataacgacgtacaaaagcggtaattttggcacgggtttttaaatgttgagccatttcaggacgacgcaaatcaagataacgatattttaaacgctgttcttctgtattattctgattaaaatctaaaggaagtacatccgaaacgttataaacagacaatgctttagctacaacttccacctcgcccgtcgccatatttttattaatttgattatctggacgagcaataacctcaccttcgattttaatacaaaattcattacgcaatgcactggcttccgtcaatgcttcttgatatttcggatcaaaacaaacttgtacaataccttcacgatcacgcatatcaataaaaattaaaccgcctagatcacgacgtttatgaacccatccgcttaatattacttgttgtccaatatggctacggttcaatgcaccgcaataatgagaacgcatcataatgacttcctttatatctgaaactactgaaattagtcgacgaattatagctgaaatctcgcttatattgaaagagcggacggaatttatttgagtgagacttaaacttcttctaaaatgaccgcacttttttacacttttttagatgaaccataaaataatgaataaagattgtatttttgctgcacccattgaaaaactgggagattttacttttgatgaaaatgtcgctgaagtattccctgatatgatacagcgttctgtccccggatattccaatatcattactgccataggcatgtttgccgaacggtttgtgacggctaactcgctagtgtatgatctggggtgttctcgtggtgcagccacgttatctgctcgtcgccatatcactcagcctaatgtaaaaattatcggcgtggataattcattaccgatggttgaacgttgtcgtcaacatattaacgcttatcagagtgatattcccgttgaaattttgtgtgatgatattcgtaatattaaaattgaaaatgcatcaatggttattttaaatttcacattacaatttgtaccgcaacaagatcgtcaattgttactggaaaaaatatatcagggacttaatcctaacggaggattggttttatcggaaaaatttcgttttgaaaataaaaaaatggacgacttgcttattgatttacaccatcaattcaagcgagccaatggttacagtgaattagaagtaagtcaaaaacgcaccgcacttgagaatgtgatgagaacggatagtatagaaacacataaagaacgcttaaagtcagcaggtttctcccaaatagaactttggtttcaatgttttaattttggctctatggtggcgataaaataacaaaaaaacagcctctgaagtaagaggctgactaagtttaactatgactttcataagcgagtagcgtattaaacataagcatcgcaacagtcatcggaccaacacctcccggaactggagtaatgaaactcgcctttttgctcgcttcatcatattgcacgtcaccgactaacttgccatcaactcggttaattccaacatcaataacaattgcaccttctttaatccattccccagggataatgtgtggcttacctactgcaacaactagaatatccgcttggtgcacatgacttttcaaatctttagtaaaacgatgagtaactgtaactgtacagccggctaacagtaattccagtgccatagggcgaccaacaatatttgatgctcctataataacagcatgttgtccgtacagatcaacgcctgtggtttccagtaatttcattatgcccaaaggcgtacaagcacgtaaggttggaatacgctgacaaagacgcccaacattatacggatgaaaaccatcgacatcttttgttggggaaatatgttcaatcactttagtagaattaattttctctggtaatggcaattgcaccaaaataccatcaatttgcggatcttgattgagttgttcgatgagagttaataattcttgttcggttgtttctgccggtaaatcataagattttgaatagataccgagttcctcacaacttctacgtttacttcccacataaacctgagaggcaggatcagcaccaactaaaataacagctagtcctggtgctcttttcccttgttgaagataatgctgaattttttcagcaacattaaatttaatgtttttagagagttcagtacctgaaataatttgtgcgggcattaattctttccttcaaatttgatctcaaatgagcaacataacaatcatttaaattattgaacatgaaaaacgctgctattgtgtcaaaaaaaagcgagaaatgtaagtcaatttgagagaaatttcatcaatcaaataaaaaagtgaaaaagtaattgactgtttatgaaagaaaattataatgcacctcatcggcgagtagcgcagcttggtagcgcaactggtttgggaccagtgggtcgtaggttcaaatcctatctcgccgaccatttttatatttattattttttatatgcgcccttagctcagctggatagagcaacggccttctaagccgtaggtcattggttcgaatccaatagggcgtgccatttaaatccttatatatcaagcagttatcactcaggcaataagttttaaatgtgtcacagatttgctctgtgccgtaaatgtgccattaaattcaaccttgtttgcgtgctctagcagatgatctgcatttaagtgagcgtatttttttaccatttcaagcgtttcccatccacctaattctttaagtgtgaagagaggagtgcctgcctgaacgtgccaactcgcccaagtatgacggagatcgtgaaagtgaaaatcaagcaaaaaacattttctagctgctgcattaaatgctttgcggttaatgtcatttagcttattattctcacgcccaacaaacacatattttgcgtgtttgccacgtaatgacttaagcaataagattgcttcgtcgcttaggagtagtgatcgtgctttacctgattttgcaacatcattagtcacgatcgctaccttacgcacaaagtctattttatcccaagtcattgtcagtatttccgtcctgcgagcacctgtcattaatgcaaacgcacaaatggctctcatccaatcactatttagcttggcaagtaagtcttttgcttgctcttttgtgatccatctaaccctaataggcggttctgcatttttaggtaggtgtgggactttgtcgaccaacccagcctgatgagcaagatttaagatccgtaaaatagactgtatatatttgtttttggttgagttggtgagcggtttgtttgtgttcatattccgggtagggatatgatttaggatttcttgagttgttaaagagctaagcacccgtccttggaatttctcacgccaatatttagcgtgtcgtttttttgtgcttgtatcttttagaccttctgcagagcgtacatacagcagtaacgcctcttcaaaaatatattctggcttttcgttaagcctatctattttccacgtttctgctttaagctgatcgtggtaatgttgagcttccttttttacagttgtgccagcagagcgtctaattctcttaccgcttggggttgtgatatcaacccaccatgggccatcttttgttcttctgtagatcgacatagtgttacctcttcgaccgacaaagctaatcggtcgctattatttgctcgttttttgagtaaatcaagatctgatttatggataagccaacgattagatcctttcattctaaaaaatccccagtcatagagatgatttctaaccgcactttgactaaggtttaagtgtttcgcgacttgttttatagtgagagtttcttccatatttcctccaaaaaataaaccctagtggtggctagggttgttttaaataatctactagtcgctccccaatccatcgcattacagggactgccattgagttaccgatagctttataacgtggactatcggggcaatcatcaatcggtttgttgcgatatgggattagtgtccaattatcaggaaaaccctgcaatctctcgcattcggttggagtgagcttgcgaataatagatggttggcaaatgcaaggtacattatttccacctgtccccattcttgcttttaatgttggtgatattggtttatctgcaattcgcacagcctcttcgcctttgacttcgaataacaccttatactgtgatgcagtcattgtaggtgcgatactaattcctacagcatactccttgtctttgcaaattattgatggatacgctccataagagcatccaccaatattttgggcagaacttttcccctcttcttggctctgattaaaatcccctcgcaagctcttttgctcaaggagtatttgtgcgacacttcgccctctagcactagccacaaggaacactcttttacgtcgttgggcaacgccgaagtattgagcattgaggactcgccaacagatagtacgggctgaatgcacataaccagagtttgtccatcttgcccctgaaggttgtaatggctgacattcttgagccagtccagccaaaaagtgtccgaatgcgttgtccttggtagataagacaccttgtacattttcccagacgagcacgcaaggcggttgtccattttgatttctgacataatctattgcctctaaaatatggattaaagctaaagttaaatttcctctctcgtcatcaaggctttctcgcttgcccgcaaccgaaaatgcttggcaaggtgtacccccaactaacacgtcaggggctttgatttcacgatttaggattttttcaggcaaggcggtcatatcgcctagatttgggatttcagggtatcgataagcaagtaaagcggacgggaaaggttcaatttcagcaaaccataaaggcttgcctaagccttgccacgccacacttgctgcttcaattcctgaacaaattgagccgtaggtgaacattgttactccaataaaaagccctcaaaattgagggcgttgtgtggttattcagtttcggatggtagcggtgggatttccgcaaatttatcaatttgttctaattcgaaagtggcattaaattcaggtatgacccagacatatacatattcattccctaattcatcacagtaatttggttctctccttggtttacgctctgcgtctatgaatgttagatacccaattattttgggattatctaaatgtggtatatttacataaacaggttgattgagttgaggcaatgagtttcttacactaatccatttactcatttttaacatccttaggcggttgtgggagtggttgccaatgagtaacttcaaaaagtttactactcatattaaattctccatcaacaagttctgacaaagtaatagatttatagtctcggcttgcatttttgaaatatacaagcactctttcgcctgattttggtagtttatctttaacactaatccaaccgttaatctctaagatttcaggtgagttgataatttcatcaatctcatcgtaatatcctgactccttttcctctttagttaatggcctcttacttgagattgcttttcccaaaataacaccataaactgcaaatggtaggtaatatccttcataattttcaaattcatccaaatcgttcgcaaaatcgtaggcatcaacagcactgtttaaacaactctgttttgcttgttccagcgtttcgtgcaactcaaccgaatgaatatcgtttgatacatcaatcgaaaagtattttttattattcatattattctccttagtggtgttattgattaatctgtaatcttaatttcacgtttaagtggatcatcttcttctggcgatccatttgttatttactatcatgttgtttctcctgtttagtgggtttcttctaaaattggggtgattttgtaggcacggatttgtcgccccagcattttttttcgggactttgaattgatattcatagcctttttccggcgttgttgggctttgtaatatctttgcattagcgaacacatagacgtcgtcacgcacatgagcgtagccacgaaccttagcattctctgttatccacgcacagtcgcctataatagcgtcttcatagacttctgcgttatctcgtacgtaggtgtcatcacatacaaccgcgttgccatataccaaagccttgtcacataccacggcgttaccatgtattctagcgttaccgaatactctcgcattgtcatacactctagcattgtcatacacccaagcatttccatcatgacttagattttcttctttctcaatataaccgcccagcttacccgcctttatatcaccaaaagagattaatgctttaattcggtagagtgttttaccattctgttgaatagtatcattttgaagaagttcgtattttttttgaacttgtctttcatattaaatttccttgtttgttaacgtcgtttgtcggattaattttttcaatcaactcatttccgaaataagctgatcgtagtatttttgtgcggcacttacgcgttcaatgaggctagaatagtcgcatagagagtgtttttttcattattccacaaacgtcattcttttgtagatttctcttactcgttcaacatcttttgcacaatattgagctacttcgttgattttgccgtcttggatgtattgccatacttttgatccgtcaatatcgcctttttgttcaatatcaagtactttgcataatttgtcgagggaaacagtgtttccataacctgcccattcggtcatggtgtcatagatattgtgacgaagtggggtgtagcaaggtttgatacggttgatcacagagcgttgaaagataaagcgatcatcaaatttagtaatgttatgtccgatcataagtggtgtagctttagtgatatgtttgcgtaaccagtcgttaaattgagttaaaatgcgagtttcccgatctggtaattgccaatcttcgcaatagaacaaaacaggtgaagtgtcatcaactgctgcaccgataactacaatttcaccaaatgcaccatcaagagcggtcttgttgacgacttcgggtttattttctgctaaccatttttcaattgtttcagggtttttgtagttagcaggggctttgagattttcacaaacatagtttttgatttcgttgttttgtgttgggattgtttcaatgtctaaatagattttcattttgttgctccttgttagttttttttgattttagtttgcgtaaaaatcggttgatgttatcgcaagttttaaattgagaatgtggactgaatacaccgtgttttgggttttcccattctggttgtttgtcaacatctagcattattaacctctcattgtttgtttccagtaatcactatcatcattctctgctttcgcataaaaaattgtgccttgatcactttttctatagcttgttgtcttgtttcgataatatccatcatcgcaccgctcccaagtgcgatatggtaatcttcgctattgtctaactcatcataaaattggctgtaaatttggctgtttggatcttgtagttccatcaaaacttcggtacgcactcgtttaaattccaaactatcctcaatgtcttcaccaaaatatgcttctgccatatggtcaaaatgtctatctaccgcttgaattaattgcatatcgttcattttttctttccttttaaaagtagcgtttttaatttttcaatagaggctaagtcaaaggttaatacgctgtgatgtcttgtttggcgatctaacttaatagataaattaccctcttcatcaaattgacaatgttgaaccttgtgtattgttttacctcgctcgctcttgattaccgcacttaaccttggatttttccattcaatagccagaacgcccagtttctcctgaagcataggtagtttctttatcccttttaattcttttgtcatgttgatgatgtcgattgctttgtttgtcgctttaatggcgatgatttcgctcaccatcggattgcaagtgcggtactctctctcatcatctacccaaacttccccataaaattttttactgattggattttgtaaaatttggattttgtagctattcatcttcatttcccctccttgtcatactgtgcttgtagttgttcggtgtatttttgcatgtagtctacatcggcttgggtaggcggtggcggtatgtcgcccttgcgtgaaatccattcaattcttgccatttcttcatcgtaggcaagttgtgcttcgggggagagttttccatattgagcaaacgctgggtgaaaataggcaaagacaagtagagtgctaagaaaaatagccacgataagaacgataaagccaagccatctgtaaaatgagattaataaattattcattttttgtttcctttttggtcaatttactgaatttaggttgagtgaaaccgccacactggaaaagtgcggtcggtttcctttgaggtttaaaatcttggcaatgccaaaggattatgtgttgctaatatttcttcgcctttttgtagccacggattaaactcatgagcaacgtcataagacaatgctccaatatcgtttcgaatgtggcgttcaagtccgagcattaaaaagagttgacgatgaaagatttctgtttgttcagcaagctttttagctagtcgagtatgtttcataatcgcttcgaataattcggcggaaatggtaatttcgtctctatctgcggtcttaggcggtgtaataatcagctcgctctctaaacaaattttgtgaacatattcgaccgcactttgtaatttatctgcggggatatcctcaatactttccacattcatatagtgatgaacaagattgtaggcttcgttgtagagtaagccttttttgctaacgagcatattgacggcgttacgtaatcctgtgcggtcatcaacagtcgttttgcgttcggctttgcccttgaaccagtaatcgtgtagagctgcatagcactcttttttgtatttgatgagtgtttcccgaatttcaggcttgcagcggttcacgtcaataccgaatagccagccgttaaggtagtcaatcggaaggcagagcatttcacgtattttactatcttctgcaaccgttgttatgataacaatagttgaatttagaatgtcatcacgcttaattcttgaatattgagaagcccaatctaaaccgatattttcgcagatcggtttcattgcggtgtaatgtgtgccgttttgctcgaatgtgactaaggcttggttgttaaaagagatggtttgagtggagacttgtgtagtcattttgtaatccttagagtctatttgtttaaaacaagccactttcgacagtggcgtcgggaggttcgaaaacccactctaaggtaagggctggacgtatttcctttcggtattgtattagtcgccctcccgacatagtcaggattacggatataaaaaaatcgcctagtggcgattagtgaactatccgccttagagtatgaggtttcgacacctatgggggaatagtaggttaaatttcttcgtttgtcaatagataaaaatgtaatatttattacaaaaagtacttgcgttaaaatgtaagtagtactacaataaacatatctaaggcaaggtgctttagatacaagaaaaccccgacttgttgggttcggggcattcaaaatggagtttaggatatgttgttcaaagcgttaatcctaattatcctcttaatggtggcaatgccagcgttctaggataatccatcgggggagggcattcccccgatgactccaatcttaagctaacttaacccaaaatgcaaggagttttctatggcaatgacaagagctgaaatcaatgcaaaaagcgataaaaagcgtggtgtgcggttgcaatcttataaacttcacgaagatgtgattgcattgcttgccgagctttccagccaaacagggttgtctaaaacccaaattgtgacgcaagggattaagctttttgccgaaacaaaaaaggtcgcataacgtgcgaccaatcccgactttctgttgaaagtgggaatatcctaaatgattgggcggtggtttgtcaatttagattttgttcattgaattgtttaattttaatattttgtagatgactggctcttcatcaatatattcaactaaaacatcaactaagaaaattttatggtacgggtattcttcatttaatatcattttttctttgagtgtcttgtcttcaaattttactcgtacaggcttttgtgatactgcaggaataatagctctatcgtgtgctttgctttgagcatctgcggtggatgaccagtatagtgtcgtgttttgtaaagtgttttcttctcgctctttgagtagttttaattctcggttaatattgttttgtgccaatcctgcaagtgcattgtctgcgtgtagatgtatatgtacatcgccttgattattagaaacttgtaaattgaattgtgctttaggatcgattgcgataggctctaaaatgttattggcatttttcaacatattcgcagtaaggcgttcaggcttttcgcctctattcattgcccaatctaaaatatttttcaagtgccctccaaattcaagaatcgcatttgcttgctcaataagtggatatgtgcttgatactagtgctgcaagctcaataaggaagcagccttgtgtgattttttctacatagatatgctgttcacagggttcaatatcaattttgttgtcttgtataaattggcgatattctgcagcaataccttccatactttgacaaaaaactgatagctgcaatggctcgctattatcaatttcgattagtagtttcatatttttatctattgtgtaatgtgtttcagcaaccataacccacctcaaattttagacacaaaaaaagccgttattgaacggcttgtagtgcggttatcttaatccgaagtggggcggttgtaaagtaaaattattttgagatagtgtactattttcttgtgttatagtgtactatcttttataataggcgacatcagcacggggctgataacaggacaaagccccacctgttgagatggggctgataacttggagtcaagacaagatgaaaaccttacaaatcatcttaatcttgattgtgctgttgttagtaagttcaccagcttactaagcacttaaaaccgatgggggagttcgcacctccccctgaggtctccaacattttaccaaagatagatcctgaaattcaacctaaaatttacttggggctaaacctatgactatgactaacgctgaaaaagttgcccgttccgatgccaagcgtggcattatggctaaaacctataaactgcctcagtcggttgtcgctgaaattgagcagttgagtgagcaatatggtattccacaaaatcaattattgatacaggcaatcgaagcgtttaaacaggcaaaaggggcgtaagcccttttttgctagtcgccgttccaacgcttctaatctgcatactgttttgttgaacttttagtcaaaattgtttccaacattaacacattgacttttatgtttaaatttagtatagtttaaacactgtatatatgtacagtgtttttttaatgttatttttaaaaggagaacgcatatgtctggatttgttgatttaactttagagtctggtgcaagtattactgttagtaaaacggcagttttttatcttcaagaaagtaaaaattcccctcaaactacgttattacactgcggtggaagcgtaacacatcaagtgaaaggaggttatgaagaaattagcgttaaattccctaattttattcaaactgagctttctgatggggtgaaagttggcattcatgattacaatgtatcttgcttggaagaaaagcaaaacggtattcaagtacatggtgtagcagtttattttactagcggtcctattgggttggatgtaaaagaaaattactcagactttaagaagaaatttcatcaaatttaattcatatttaaccgcctgtttgggcggttttttgttggttttatgccgcacttttggttaaagtgcggtcaattttagctaaatttagatgtatatatatctcaaaaaggaatttcatcatcaaggttatctgctaatgggggcggataagatgatgaggttgattgcccataaagttgttggtgggcttgataattttgttgttgatcttgttttttgcggtcgtctttatctttaatgtgttcaataagccatttaatccgttcagctggtttattttcaagatgctctgccaaggttttttgggtgttgtggaagaatgggcagagaatctgaaagccgtaagtgtctgaaccgtcttgtttggtgcgaaggactttttgcagcattaatccaatatatttgccctctaattgtggtgcgtacgctttgttgtctttaaattgtcgtgtaagttcagccactctcgtgacccccataattgcttgtatcatgttgtgtccgctttgtagtgggctaccgtctttaccttgataatagattgagaggtaatttcctcttaagccatcttttgtttcaacagtcagttcaagggataatgcaccactttgagactgaacatattctgcactgataattctgcaaatatatgctcctgtttcagcgataaaactggaattaccagctttgatcgcttgttcttgattgtaagtgaatattgtttgtgtcatttttcgtttccttgtgttggtttgatgtcgtagtaatcgcaaatcatttcatcaacggcgttgaggtcgttttcaatgaattgcgtttcaaataatcccatagggctttttactgggtcgttaccgttgttttgcgtagagaattggaatttccagtcatttacttgtgtgcgtaaacagatagtaaccatgccttctagcgtaattttttcatcaagcattttgccaatggttttgattttggttttgccaaatggatcggtttcgacgtgcgataaaatatagatccgcttgttcattggtagctttaatgcggtattaaataccgtccatgctttttcgccaatgtcagtaaatttgtcatagcctctttctttcgcacgtcgcataaattcatttgccataatgtattgataatcatcaatgataatgatttcacgcggtgttctagtcatagccttgcaaatagtttcagtatcatcacagacaaaaatagatccgctagggttatctcttgtaatgggttgccattctttcgccctaaatggaagtggtttgctaattgactggataagaagtgttttttgtgggtcgaggtggcgtaggctagttgatttgcccgaaccgctttcccctaaaattaaggttgttatgctcataatattcccctaaaaaaaaccgcactttaagtgcggtggattttgatgaagtttagttgttgattaaagtatcttgtatcgttgtagtcttcgtttttggttagagtgttgagttttgtttttattttttacttctaacagtttgtcaattaatggaagcgtgtctttaatcgctttttttgtccaattcaaattcaattctacagagttgaaaatatcgcttatgataatcggtttgatttttttaagtaagaattcaacgctttcagcaaagcgagtgaataacatccatacatcgatcatcttttttagttcactttcagttagttctaaagtgaatttgggttcaggcattggtaatttaagttgtgttgtttggttttccagttggtttaaaaacgcacgcaaaaccacaagatgaaattgtggcgaaatccacgcagcgtaggcgatgacgatttctttgcaggcgtatgtgccaatgccatttttgacaattaaaactgagctgtgagatttctcacaggttggattttcgctttcaatctctgcaattagagcttttgtttgatcatttcgcaaaaaataagtaggacgatgttttggatcgttttcacttgccctatgaagatctgctaatgaataaagattatttaaagtacgaattgagttattaagaattgctaaattagtcattttgactgctcctattggttttctgaaattgaccagttctgacactggtgccgagaggttcagaaccctccaataggttagggtggacgtattccccgaaggtattgtattagtcgccctctcgacgttgcgagatatcggcataaaaaaagatcgcttttggcgatctgcttactaccgcctattggaaaaaggttctgacaccttgaggcagatagtaagataaaagggtggggtttgtcaataaaaaagcctgtgttgtaaacaggctattttgttattttcttttttgttttctaggtttatcgtatttaatcatttcacgatttgcaccttttagtgttttcttcacttctttaatattctgttcaagttcaagatgttcaggtgcaatcccactattttttatcatcatatcccgaacttctttaccaacttgagaagcggtattttgtaatgcatttaaaccacgtacattcttacttttaattcgttctgctgtttgagttactctaaaccagttacctgcaagttcagtatttcccataaagtcatataaagtccctttttcatcaggcatctgtttatgacgtttaagttcagctaagcccatattatacataccacggaatcccgcatctttaaaaagtccaaagtgttctggtaaaagcccagcacctttcgcagaagctgacataatttgttctccatcagctaattttttacggatttctaaacgctgaatagcgttatcatcaatcgcattttggactaatttatctgcaacagcagccaagattgtttttgcttgagcaacttgttcttttttagaatctgcgtgcattgtgataagaaagcacgcaaaacgagagagtttataacttttcacctctctaccttgaaagacaatgtcaatctgcgagaagttatccattatgtcaatttcaaggttggcacaagacgacatcgctttattgataacgcttttgaatgagttccaagactcgtaaccaagatgtagcataaaatcgtgggcgtgccagtatctaatgccattttggtgagcatcattttcaaagagttctaaatcaaattgttctgccattgtttacccctataaaaaaagccgttattgaacggcttgtagtgcggttatcttaatccgaattcggggcagtgtcaaataaaaagtttattttatataaaatatctcttgcatatcaattggtatattatataatatacttgtttttgagatggttcaaaaatgagaagagcggctcaaaccgctcaactaatggagatagaaataatgaaaaccgtacttttcattatcatcttgttagtgttgttattggtaagtcctaacgtttactaaacactaacccggagggggaaaggtcagatgttcccccaatggctccaatcttaagctaacttcatataaaaggcaagcgttatggctcaaatttccgaacagttgcgtaagcgtaaaatagagacagcacgacgatttaacgataaagcccttgcagaaggtaaggcacggcgtattttaatgcaattatcagccgaggtagccgatgaatttgacgctatctgtgccgaattaggtatttcccgccctcaagcaatcaaggcattgtgcgagatgtatcgggcaaaaggggcgtaagcccttttttgttgtctaaaaaaagcccctatctctaggggcaaactcacattacggatttcatatattgattatgtcaaaagtaccgttttaaccactcggcgtgtggaatggtgtagtgcgaccattcagaacggctctcacaaggaaaaatctgaaaaaacttgtaggagaaagagagccgttttgaatggttgcctttctttgacctgtaaggctcaggtgttgtcacgtttattttttaacgagtatatcggttactctcttgtgcctcactatgcacgcccagatttcgcctaaacctattattgggttatgtctttgtcttactaaagcgtaagcataacgctgtggcaagtggggggttttatgggcttcctcttgtgtttccactctgacttgcttcaccatcgggcaataataggttctatccaaattgtgtcgagatgaaatgaaagcctcttgtggatttttagagtatgataggtctaaccttgtgcctgctgatgatgttcctgaaaacgttccttaaaattgattttttcatcaaatggaatttcttcacatagttcaccatcataggtagcttgggacattgccttgattttttctttggcttcttcggcgttgttggcatatacatcacagcaccaacttgtgccttggaactgatagcgaaaaaggtattttttcattgttttttcttccataggtattccttatgcgatttgaaacttacttagacaaacgccatgagtggcgttggcgtttaaaggcaagtaatggcaaaacaatggcagatagcggtgaaggctataagcagtattttgactgtttacatggaattgatttggtacgacaaaccaatcagttcacagatattatttgccttggagacgataaacattaattccaaagctccgcaaggggctttcatttcatctcgatttttaaagagcgttccttgttacaggatttatttttgccatttccaaccgcacttgagattaggtcgatactctttcagtttcgtgcgataaatcgtcgttttatccatttttcaacggtcaaataagtgcggttggaaatggcgttgttttgttttgatgaggttattatgtacctaacgttcactaaagtaaagaacaaaaagtacaaatttttaaattaatttatgtactttaagttattttattgatttaaaaagaaatttatttttgaaaaaaatgattgattgcttgttttttgagcaacttaattaaaagggtgtgaattatatttcacagtttatttaaaataagtataatacttgtagcggagagaaatatgatccaaataaaatcaaccacaatttttaagaaatggcttgatgatttaaaggatttgagagcaagggcaaagatccaaacaagaattaaacgcttacagctgggtaactttggtgatgtaaaaactgtaggagaaggaatattcgaattacgcattactgagggcaaaggctatcgtgtttatttcaaaaatcagaatggtgtgattgtaattttactttgtgctggtgataaatctacacaggaaaatgatattaaaaaagcaaaaactttagcaaaagaattgggggtataatatgactgaattacaagattttgatatagcggagcatttaagaaatgaggaagaaatccgtttttatctaaatgaagtgatgaaagagggggatgtagatttaattctttccgcactaggtgatattgccaaagcacgtaatatgagccaattggcaaaagaggtcggggtaagtcgtgagggattatataaagccttttccggcaaaggtaacccgacattttctactgtgcttaaggtaatgaaagcattgaatttaagcctcgagattaaacagtctgccgtcagtttgagttaaagaaaaaaccgccgaagggcggttttgttattgatgctcaataacatcaagaataattgcatctttaattttttcatcaagtattttggcattaatactcagtttaaccggttttctttcccattctgcttgcattagcaataatttgtttttattacccgctaaaaactgatcttgaacaatcgcctcaaatacagcctcagtgttcacgttgcgaattcgtactttaaaaagttctgggtctgaagagtttacttgttcaagtctataagttccatcaagtcttatttcggttgaacgacggcgtgcatttttagtaagctcagtcgttatttcaggatctaaaatactattacctatttcgacttctttcacaccaataaatgatttaaataaacacgtttttgcatcgtgagcctgacgatcaatattttctagaacagcattttgtttcacgatattagcaataatcccagctcgttttgtttcctcttgcgacattagttgtaaagattgaaggtgctctttatcttcatcttttttaatttcagcaaggcgaacttcttttctattatctaaaaatcgtttaattcctgagcttgttgcccaaatagcagcactaccaagcacagttattgcaagtgttgttgcatccatttttgtagccaattgccctatttgtatccataaaccatcaaaattaacattcaatagcgacgaaccacgctcaacagtaatttttaactgcaatgcctcacgttcttcttttgataatttctgcgtatcaacatcattatattgaattagacgataggttctattaatgtaattttgcatttctacaaagcctttcattatgtttggcgtgaggctttgctcaaacttttcacccactaagcgaatacttagtggaggtagtttttgtagatctatattatcactaattaaacctgtttcgatataatcctcaagaattttaaataatttatcttcagaactgataacaatattattcatttcatttaattccatattttaactccgttcttacaaacctataaattagatttctgctgtattcagtttccacattgctgtggcacaagatttatctttcagtttgcaaccctacaaacagctcctatgttcaacggctttgccgattatttttattttatggtgtttactgcttaacgtgccgaaattgtcgttgagaggaacaagtttgaaatgttttctgccgtgttcgtctacttcgccagtttctttgtattgtttgaaagtggcttcgttatcttcgttgattgcgacaacaaaatcaccggggacgggatagatttcgggatcgattaataccatatcgccttcttggaagcgtggtgacatagagttgccgacaatttttaaataaaaggcattttgacctgctttgacttgcgaggagatcatttcgtattgggttatttcatctgtattactcagcaaattcacttcggtaaaatagcctgcttgtactgggctgagtagggggtagtagaaggatttaacgacttctacaaatgttgcattcttatcaaaatttttgacatcaccaaaagttagccattcaggggtaacactaagaaaatcagctaatacataagtatttgcagtagatggcatggtttctgcattaaaccatttactcacagctttaggtgtcagttttaatatatctgcaatttgtttgccacgtcctttgtttggaagccctttgttcttacaggctaagtctaatctttccgcaaacgcttttctaatttcttcttcattcattcttttttcctctttgtactgttagttcaattataaaaaaaacttgaagtactttcagttatattttaatatgtacatttagttcagtataagaggtaaaatatgacatcactagtacatattcttgatttagcagggatgcctaaagttgcagaatactgtggggtttctctgcgagctgcctacaaatggcgtaaagccaatgccttaccaagaactgaatatacaggagaaacaaattatgccaatgcaatttctgaagcgattaatggtcaattttcttctgattttattcgtgaagttggcagacctaagcctgctgaaacctaatctacctcaagaggtatgcaaaggctcgcaaggaattaacaaaaaaatgcaagggcgattgcggatttgatttttcgcaaatctagcagtcgcactacaggaaaaataaaaagccactgttggagcagtggcaaggattaggaaaaatcgctatgaatattaatccgaatgaaaaacaaagtcaatcgcagaatgcgaggattttagctcatttaaaaaatggtgggagaataacttcgcttgaagcgttaaatcaatttggctgtttgcgtctttctgctcgcattaaagatttacgtgattgtggtcatgaaatccatgcggaatttattgaagtgccaaatggtaagcgtgtgaaacagtattttatggaggcatttcatgagatttagtcaacacttacgacaattgggtcaacctattgcgtattatccaaaaatggcaaaacccttaggcggtgtgactgctgcgattttattttgtcagcttttctattggcaagataaaaccgacaatccgttaggcgtgtacaaaacacaagctgaacttgaacaagaaactggattaagtcgccgtgaacaggaaaccgcacgcaaaaaattagttgaattgggtcttttaatagaaactcacaaacgcttagaacatcgtatttattttaagctggatttagcgaaatttgacgacctaatggctaccatttttgaggtagaaaatccgacattacccgatggcgataatgtacaaccccgaatggcggaaagcgacattcgggaagtagcaaaaccgccattcgttaatacaaagactactacagagaatacaaacaataaaaaagatttaactaacgttaaatccaaaaaagccacaccaaaaccgaccgcacttgctttgcttgctgaatttggcattaccgatcagcttgctgaagattttattgaacagcgtaaagtcaagaaagcaccgattacccaaaccgttcttaaccgcttgcagactcaagccgatattgccaaattgccacttgtggaggtagtggcgattatgattgaccgcaactggactggctttaatgccaattgggattggaggggcgaaagccaattttcaggtaaagccgagccatcaagcaagcctaaattcagcgatgaaaacaccacttggtggcaagggcgaaccattgaaatttatggagatacgctgtgaaaacctttgaaaatgcgaccgcacttattggcagtaacccgaattattctgcacctgtaacacaagggcaaaaacaggaaattcctgagcaagtagcgaagtatgttgaccgattatttgttcgtttaaaagccatttttccgggctggaaagcagcgtttaactctgatgcagagtacgaggaagcgaaggctacttggttgcaagcattggtgaataatgggattaccaaagcagaattatttaaacgtggtttgcagttagcagaacgctcagaaagtccatttttgccgagtgttgggcaatttattgcttggtgtaaatcaggcaatgagtttgaggagcttggtttgcctacgcctgaaacgttgttgcaacgctatcaagcatttcgtgcgagttgtgaggagccggagaattatccttggcaaagtgcggcagaatttcacttagtttgtcagttaaaacgggcgatttatcaggagaatttaacccatgagaagttactgaacaaagctcagtcgttgattaaagccatggcaaaatatctcaaagaaggcggtcaattagcagcaccaaaggcaaaaaaattaaccgcaccgaaagagccgaatttaacgcctgatgaatgtacaaaatactttgcagagctacgtaaacaaatgcgtggcatgacaaaaacggtttagcaggagatgataaaatgcgtgttgaaaaaaatgcgtaccgcacacctcgttatgtttttaattggttagaacgtcgtttttattggtttcatttagacggttgtgcgaatgagcataatagcttacgtcatcgttggattggcgagggtagcagtgttgcaacagattttttagcagatgatttgtttgatcgcttaattgatgaagtggttgaacaagcggaattattacggattttcgttaatccgccatacagtaatcctttgccgtttgtacaacgtgcggttgagttgatgaaagcgggttaccttgttgttatgttgttaccggcggataaatcgactaagtggtacaacgtcattcaggataatgccacggaagttatcgatattatcggcggtcgaattaactttattcatcctgaaacaggtgaggaagtcaaaggcaataacaaaggctcaatggtggcagtgttcgatccgtttattcaaggatttgtaactcgtcaagtgagcttggattttgtgaaagagtgcggtatttcatagtgagatttttcaatggctaaataccaaatgatgaaacttgcaggaggggtattttctccattgaatgatactgaggctgaacgcttgaaatcttttcagaataacgagcaatatgaaattgaaattaaaagacagcgtaatccagcatttcatcgtaaggtgtttgcgttttttaatttctgttttgagcattggtgtggtgagcattccgattggaagtttcaagatgaaatagctcaatttgatacgtttcgcaagcatttaactgtattggcagggttttatgttaaaacgtggaatttaaagggtgaggtgcgtattgacgcacaaagtttgagttatgccaatatggagcaagaggaattcgagaaggtgtatcaggcgttgattaatgcggcgttaaaacacgttttcggtcatactcaagacgagaatattattaatcagctttattcgttcttttaaaattgagaaataaaaaaccgcacttggaagtgcggtcggttttaagtaagtttagcgtgttttcagtggcaagcggttttcctgtttgaggcttgccagcattcgtttaattgtcgggtgggtttctttgatgttctgcttgcagaggttgtaattaaactgtgcggagcgttcttcaaagcggtcaaggtcaaacccgaaggctttaagcaggaaatacacgctttcttgaaaacgggtaaactgcatccacgtgttgatgaagttgcgtaattcgctttcggtaaaagtaaaagtgactgtgggttcaggttccggcaaggcaaactgtttcggttttagctgatatttccccgttttacggatttgcggtagcacttcttcaaagacccagttttgaaactcgaccgcttctggtttgtttgagcggaaaatcacacgataaagatttggctcattgataaagatcatttcctgatcaccacttgtggtaggggtggaaagtttttccaccccctgcggattgaatttaaatttgcttacagagcgattgcataagccaagaacagatgcaacatcaagcaaacagaaaaatggttcagaacctaaaacgtgaatacgtactgggaaagatttgaagttgaatgtagagatttgatgagacataagtcttctcctgatgtttagtttagtgtgggtgatcgggcttcaactaccgcatcagacggcggaacttatttccgaaaaggtcttgtattaagttctctcgacccgatcattgaaaattgtaaattttggatacaaaaaaaccgcttgtctgacggttgcggttatccgctgatgtttagtgattacaagattataaaaattaagttggttcgtcaagagcttttgatagtttcgatacgaacggggttagatttgaagttgaaggtagaaatttgagttgacataggtcagtccttttattttcgaagttttaccctatggatagggcgagcgagaggttcgaaaacctaaggcaggtcggagttattcccctttcgggtattgtattcctcgccctctcgctcattgaataaatagtttaccgttttttagatacaaaaaaaaccgcaatggattttaggtgctgcggtttcaccgccttagagggtttcgacgccctgtgaaaaatatcctacgcctaacagaggagcttgtcaagcgtaggggattgattaagccgataaaatcttgtcagcggcgatttgagccaagaaaccgctacggcttttgtactctttatgcgttgccacaaattcatcaatacgcttgatgagataagcaggcattgtgatgttgattttttcggctttgcctaagaggtgagtaatatcaacatcaacgaaaccgaagaacatatcgtactcggtaaagtcgggattttggcggtggttattgattgaggttggtaatggaacttcttcgcccatttcaaccaataattccaaatgccctttgatggcttctttggcgttagcataggcttcttccaaagtatcaccggcagaatggcaccccggaatatcagggacgataacgccgaatgcgtgagtttcatcgcccggttcgattgcgattggatataacattttatgctcctgtatagcagggctatttcagccccgcttgtttaagtattgaatgttccgttcctttttttaaatccttttcaggatgttggacggtaacaatcccttttttggttggatgagtgaagtggtggtggcttcctgttgcgtggtggaatttccagccgtccgcttcaatccgtttaataatttgtttgctactactcacattgctttgctcctctgtattgctaatcaatgtggttattatacctataatttagggtgacgcaataaaaatgtagattatacccacaaattttaatttaagtgatttaaaaatgaacaaataaagtaaaggaggttgaaatggtttgttatacggtgtggataatgatattggctttgataggttgaaaatgattaaaaaagtgcggtcaaaaaaatgcaaggtttgcggaaatgcgtttaaaactaatgatagttttcgacgatggtgtagtcctgaatgcggggtgaaattagctcaaatggcattggtgaaatctcaagaaaaggagaagataaaaagggaaaaggaagaaagagcaaagattaaggcggttaaagagcggttgaaaagtcgatctgagcgtttaaaagagttgcaaggtgtatttaatcgttttattcgcttgcgagataagaatttaccttgtatttcttgtggtcgctatcatcagggacagtggcacgctggacattatcgtagtgtgggtgcttgccctgaattgcggtttaatgaggacaatgtgcataaacaatgcagtgtatgtaataaccacaaaagcggtaatgtgattgagtaccggattaatttggtggctaaaatcggggtggaaagagtggaatttttggagagaaaagaccatttaccgttaaagctcgcagatgatgagattaagacgttaattcaggtttataaggcgaaggtaagggagttgcaagatgcacaatagtctaaatgattttaagaaaaaatgcagacaatggggatattgggctacgcctagaattggtacggaatatccgagtatatcaccgtcaattccggttccgcaggataaatattgtggtaaagtcgatccaattaatgaagatcttgcaatggagtttgaacgttgtgtgttaattatgcaaaaggtaactcgagaactttacgatgttttcatggtgacttatgtttatcgcttgccgttgaggaatgaatatgacaggcggagaattttggtgagaaaagggatatgtgaaaccttggatataagcgaaacaacgtatagaaaatatctttatacggctgaaatatcattaaagcttatgttaagtcaaaataggtgtatttttgttgcataaacctccctcaaggcggtttattcttaccacaaactcacaagctaacttacaagcagcttctcaacaattcgcaaacctatcaaaattagaccgcactttaaaaggctgaaaaaacaaaggggagcctgacgctccccactacacgattaaaccgacttgttatcgcccttgtttaatcgaccaactgtttttcaaattggttttacaagcccctttcgggtacggattggattttactttaattttaatgctaatgcagtacagtttttaatcacttggaaatcagtatcgctaacaagtggcgaaatataatcacgcttaccgattttataacgatctaatcgggaaatcgagacggtataaatcatatcgcatttcgcccagcactgaatgtttgctttatcaggcaatggattgacaggcaaagcatagtgatatttttctaagggttgaggttctgttgtactgagcggaataaccgtgactaattctttattccgtttatgttttgcaatgacgacaacaggacgaactttcgtcatttccggtgattgaaactttgagaaatcacacattagcaccgatttttcttttggttggtattttaggctcattgtacttttattgatatttttcatcgatcctacattaccgtaaaaagaagatcaacaggaagcaagccacgctttgaaaccgtggtaaaaatcttggaagcctttaaccttaaattagtgccgacaataaaggcattgtaagttgataatgattaatttgcaaaaaaccttgcaaaagacgccgtaaaagtgtagtatttcagctatggtgcggttaagtacacttatagcataaataaacattttttacagccctgagcagacatgctcggggcttttttatgggatttttttggtgatttattatgaaagatatggggacgcaaagttatttgtggtcgggtctcagtgggtttatcgcttggctgggcgaccagcaaaatttgatgatgataagcctttctatcgggattgttaccgcttgtgtaaatctatatcaacggtacaaggaaagtaaacttcgtaagcgtgaaaacgaacgtgcggaagaattacatcgacttaaaatggcaagattacaaaaaggattagatgatgagtaagttggttaaagttggtggcatttgttcggtgtctgccattattgccttgatgatgttgaattttgctgacaattttcgcacaagccaacaagggcttgagttaataggacaggtagaaggctgtcgccgtgacccttatcattgcccttctgatgtgcttaccgtaggaattgggagtactgtggcaagtagcggggcaattgaaccgcataagcgttattcagatgcagaaattgcaaagcgttgggtaaacgatattcaagtagcagaacgttgtgtaaatcagttcgctaacggtcggctaatgcctcaatctgtttttgattcagtggtttcaattacgtttaatgttgggtgcggtaagttatctcgctcgaccatgtttcgtcaagcaaatgaaaaagattggagaggtgtttgtaatgaatttccaaaatgggtttatgcaggcggtaagcgattacgaggacttgaaatacgtagagagaaagagaaagcgttatgtttgtctggggtaaaacaactttaattgcgatattggcttttttgggcttgggagttgcaatgtgggttcaggtacagaggattgatagcttaaaagccgacaacgcttcccaagcccaacttattattcgactgactgaacagctgaagatagagcaacaggcagtgcaaatacagcaaaagatagctaatcaatttaaagtaaagatggaacagagcaatgaacagcttaagaatatcttgcaacaagagacctgtgcaaaagtggcattgcctcgtgatgttatcaatattattaaccaattgcacaacaccaccgcaaattgaatatctttctccaccacaagcctacactattccttgtgaacgttctgcttttcaggggaaaacttatggtgatgcaattaagcatttaatcaaagtaatggctgaacgggatttatgtgcaagtcagattgataagattcgggaatggcagattgagaatgcacagcattgagattttaatgttaatggtttaattatggcgaaaaaaaactggaaagcgttgcaaattgaatatctaaaagcaaatgccaaaacaggtattactgttaaagattggtgcgagaagaaaggattaaagttcgccagtgcgaaacgttatataaaaaagcctgaaaccatgtttaatcagtctgaaagccaccaaacagtacgtaaagaaaaacaagcagaagcaataattcatcaagaaaactgcgaattaaattgcgaaacggacgaaaaaactgcgaaacgaaaacaacgctcttatgtgaattcgcagaccgctcgaaagcatggtggttatgctcgctatttcaaagacaaatctgcctttgatgttgtagtggattttagccttaaagatgaaattgatttaatgcgacagcgtgcggtcagtgcggttgaaagtatagaaaaatttaccgcacttttagcaaaagccaacaccgcagaggaaaaatcactttatgcgaagctgattgagtccactgacaaagcacttgaaagagcggtcggtcgcattgagaatttaaatcacacggacaataacattgcaaatctcttaagccaaattgaattacgtaaggttcagtctaagaaagtaatggcggaaacagaaaaacttaagcaagagatgaatgcgaaaacagcgggacatcataagctcgaataccttcaggagtttaactaatgcgtattgtttatcgtgcttcagaaacgtttaaaaaagtacatgcctcaactgcgttggttaaagccattcgtggacctatcggtagcggtaagtccgtggggtgtgtgttggaaatgtttcgtgttgcacaacagcaagagccgaatgcacaaggcgtgcgaaaaactcgctgggcttgtgtgcgaaacacctatcctgaattaaagggaacggtgattaaaacctttcaaacgtggatacccgagcaaatttgcccgattaaatacgacagtccgattacaggtaagatgaatattaatcatcctgatgggaaaacacgtattgaagcggagtttttgtttctttcgatggataagccaaaagatgtgaagaaactaatgtcattggaattaactggtatttggatcaatgaagcacaatttttacccgtttcactggtaacagaagcggttacacgtactggtcgttatcctgaaaagcgggttgaagaagggtttatgggggcgacgtggaacggtatgattatggatactaactcgcccgatgatgaccattggtggtatcagtttgaacaagggattgatgaggaaactgaacaaccgttaaagcctaaagggtgggagttttttgttcaacccggtgcattaattgatattacaggcatgcctttagcgacattatctgatgagataaaacgcaatattgaacaaggacattatgatgattatttaggacatcgttttgtggcaaatcccatcgcagaaaatgttattaatcacaaaaaagggcatgggtactggtttgataatattcaaggtcaaacattgaactggatcaaatctcgggtctgtaatgaatttgcaaccgttcaacaaggcaaacctgtttttggcgatcacttcaataaagaattacacgtttcaacagaaaaactggtaccggtcaaaggttgggaaacctttatcgggttggattttggtttaacacctgcggcgattatcggacaaattgcacctatcggacagttgcggattgtagatgaaattgtcgcaacaggtatggggattgagcgttttattacggagcaattgtcgccattgttaagaagccgatatgcagagtgtgctattcaaattataggcgatcctgcaggtgttcagcgagcacaaaccgatgaacgcacgtgttttcagttgcttgaggaatatggttttaatgctcgtccagcagaaagtaataatacgacagcaagacttgaagcagtgcgttggtggttatcccgtttagtaggtaaaggtcagccggcaatgttgattagtccgcactgtaaaacattgattaaaggatatgaaaccggctatgcctatcgtcaattgaatgtgagcggtgaggaaaaatatactgaaacaccggataaaaatcggtattcacatccgcatgatgccaatcaatatctttgtttaggtgcaatgcctagcctttttaaagagcaggttatcaatattaaaacacatcaaccactaagcaatattacaggatattaaaatgtcagaacaacttgcaaacgccattgaaagctatggacgaacacttcaaggcattttacaggagcaaattaaacaacgtcagcccatcgtgcaacgttggacgaaagatatgtatcaataccgcaatcaatatgaaagtagtgttgacacagggaaatctaaagtctttgtgggatatacgagagcaaaaaccgatgcgtggtcggctcagatgacagatatgttatttccaagtgatgacaaaaactatggtatttcgccaacgccagtaccgcaaattgctcatcttgctaaacagccagacagccaagatccaatgcaaatgcaacaaatcaacatggcaaaagagctaatgcaacaagccaaagagcggtcggaagctatggaaaaattgattgatgatcagctggcagaatgtgactatgcctctgaggttcgccttgccttgcattatgccgctgtacttggaacgggtattttgcgaggtccggtagtagatacaattgatgagcgtatttggtctgatgatggaatgggtaattggtccgcacaaaccaagtctaaaatagtgcctaaagtgcggttagtgttaccttgggattttgtgccggatatgaccgcacctacattaaaagactgccaatttgtctttgaacgttcttacctcactaaaaaacaattgcaaaatctgctgaataacccttattacttagccgatacggtgcaagccttaatcgaaagcgaggcaagcgaaacgcatacctccagcagtgatatggacggttatttagacacccttcgaaccttatccggtttagaaaaagcaagtaatgataaacggtatgaggtatggacttatcatggtggcattcctgtttctgtcttagagcaagctaatcaatctttagaagaaggctatgcgttggaattaacggaagagcaaaaatccgaaaaagcggaaattgacggcgtgattgtaatgaccggtaatggcaagattttaagtgtgaatcttaatccgcttgataccgcagagtttccttattcggtgtatacatgcgaacctgatgtcgcttgtgtatttggtttcggtattccttatttgtgccgtgatgcacaggaaattcttaatactgcttggcgaggaatgatagacaatggtgtgttaacgattggatcgcaaattgtcgtcaatagttccgtactttcacctgtcgacaaaagctgggaaattaaaccgaataaattatggcgaaccaatgatagagcttctgctaatgcaagttttgaagctcaacgagcttttggcgtgtttaattttgaaagcagacaacaagagcttgctaacattatccaactggcgaaatcctttatggacgaggaaagcggtttgccaatgattgcacaaggtgaacaaggtcaagttacgcctacattgggtggcatgtcaatgctaatgaatgctgctaatgcggtacgcagaagacaagtgaaagaatgggacgaccaagtgaccaaaccgcttatccgccgtttctatgaatataatatggcgatggatgacgacccgaacatcaaaggcgatatgcaagtagtggcaagagggacgtccgccttgttggtcaaagaaacacaaacggcacagattattgatattttccaaaaattcggcaatcaccctcaattgtcttatgcgttcgattggtatgacggggcaaagaccttaatgcaatccatgagtatgggggcgaaaacgatgctgttatcaagggaagattatgagcagaagctccagcagatagaacaagcgaatgcgacgcaaccgcaagatccggaaattctcaaatctcaaatgcaaatgcagttagcacaaaaaaagcaacagcatgaaatgcagcttgaacagatgaaattgcaacatgccatgcaaattgagcaaatgaaagtagccatcaaagagaaagagcttgaagtaaaaatgatggaaattgaaatgcgacaacatcaagagcaagaaagaatatcacttgatgaacgtatcaacagtgtcaaagtctcttccgatatgcaacgagaaaccagcaagcaaatgttagatatgaagaaattccaagcggaaattgctttaaaacaacaacctgtcgccaatccaacaggaaactatggtgtagagtaattattgacattgtagaagttcagtaattccaaaaaaaacaaaccccaagtaacggctaattacttggggtttttcattccaaataaccagaatataaggaacgaagatttatggaaagtttaaaacttatcctatcaataatcaaggagtttagaaaaatgacagcacaactatccaatttacgcttttgggggctttggcttattggtttcttgattgcattatctatttttatcaatgcagtgaagtggtggtaacgtaattcccaaaaacaaaccccaagagccgcaaactcttggggtttttatttcccttaaccttaagcacacaaggaaaataatcattatgaattttaatatagagattggaaaaatgctagaaattattgcgaaataccccatagcagaacgctttgcttatgtatttactattttgttttttatctctgcggtattgtggctttcccccgattttttaaaagccctagcagattttatcttgacgatgaaaaatagttagagtagtatttacccatagagcttcaaaactcttttgtaacaatctaaaaaattcaatctatggacagggtggtgcggaaatatccaatacccacgccgtcgttacagcggttttgaacaccctgtccgcccacattctattcaaaaggaaatgtaacaatgtcaaattctactcatgtggtaaagccttaaacgaatggaaaggcaaaaagccggtattagaaggtgtgatccgcattatggaagataaaatgcaaattgaattaccgcttacagaactaccaaaactcacacaaatctaaccgcacaaagtgcggttagattttactggcagtcagtttgaatgccatatttttcagcgtaaagcaaaatagcctcagtaatcattgcattttgagcaagaccccgttcaaggctaattttttcgacgagatcgaaaatgtcttttttaattttaaaggatttggtttttacgccacgcttatcatcagagcgtttttgaatttcagcggttgactttgccataaatattctccataattaattttgaagaacgagagaggtttccccctctcgttgaattatcatcaaattagtacgctggcaggctaatgactaataagatgataactaggataatgtatttaaacattgtgttatcctcttcaaagttgggtggattgaaggtcgcacccagctcgtttccgcagtattgcgaaaacaagaatattataggtcgttttatatttctggtcaaggaataaaacgacctattttttatttgacttttaaaaatttcagtagtaatattcttctcaaggcgtcgaaacctaaacaaacagcggcaatccgcacccgacagcatagcggtttttttatgcgtaaaatttgtgatctgtttctttctctcaagaattttgattacgcatacccaaaatttatctatgtcgagagggcggagaatacaatacccgaaaggggaataatcccgaccgtctgtttgcggttttcgaacctctcggcaccctattgaatagggaaaactaaacttcgaaaaaacaaacaggagcagacttatgtctaatcaaattactactcaaactctttctttccatggttcagatcttattactctcaaagttgaaaatgttatctacaccgctattcgtccgattgtagaggcaatcggtttggactgggcaagccaatccgtaaaactaaacaaaaataaagaaaaattcgggtgttgtgatatcgcaacacctacaaatggcggattacaaaaaatgctctgtatgccaatcaaaaaactcaacggctggctgtttagcattaaccccgaaaaagtgcggtcagatttaaaagaaaaagtgatctgctaccaagaagaatgttttgaagcactctacaactactggcactttggcaaagccgaacgcaaaacgactgttaatgaacgcaccggcttacgcaatgctgtaaatatgcttgttagcaaaaaaggcttactctacaacgaagcctacaatcttgttcatcactatatgaatgtggaaagtattgaagatatccccgcagataaattacaaagtgcggtggagtatgttcataaaatctgcttggagggggaactgattattgactcaccgaaacaagatgatgaccttgcagataatctaacgttaacctcaatgtggttcgcactttacaattgtttagatttgttagggcaacttgaacaacctttgcgagcaattggctcgcacttcggttcaacggcatacactcacgctacggaatatcgccatacattacaatttgcgagagatgtgctaatgcaaaaattagagggcgtagagatcagctcttgggaagagccacactaccatttagcattgaaaacaatgcgagcaagagaatacccactgagaagaggtattaatagacgataatttagcaaaaattcacaaaccagaccgccaaaagtgcggtctttttttatttatttttaaggaaataccatgtcagactttagcctttccaatgaagaatttcagtatttgcaaaaaaacatattaggtatcgcaccaaatgcaacaggttcaagagaacgaggacaatcggatgtcgcagatgagggttcttcgtccattgatgtcatagctaaccaatacaaattgccggaagagcaaggtttttttgcggatgtggttgatagcgttcaaatgggggcatggcgtggagcaggtgatttagcccgaggtataggagctttatttaacagtgaatggttaaacaaagcggctgattatgcctattacaacgcagaagaaaacaaagcgaccatgtcaagcaaaatgcaagaagccttggggcagagtgcatttgacggctggaatgaggaaactggagaaggcaaaggtttactcaatatgtattggtgggcgggcaatttgggagcattgctcggtgaaaacattgatacagttctcaccatgggagcgggtaaacttgcgacaacaggaataaaagcaggcggtaaacttgccggaaaatatttcagcaaagaagtcgcagaccaagtagggaaagcagcggtaaaacaagcaagccgtttcggtattcccgctcaataccacaaaaccattgcctacacggcgatcgcctctgctatgtcggcgggtaatcgtgcaaatcaagtccgagaggaattatcgcaaattagcgataatgacctagctcaacataatgactttcgtattgcgtattgggatttaaaagagagtgatgaagggcaaacactttccgaccatgaaatttttgaacaagcaagacagcagtattacaacaaggtcggacgagatgcgatactcaatcctcttgcgattgccgcagatattactgctaatgctgttggtggtttagggggtggtctttggggtctaccaaaggtaaataaatggctgggcaaaccgacacaaagtgtcaaagagggtgtattaaaaggggcatttattgaatctgcaacggaaggcttacaaggtgcggctgaacaatatgccatcaatgacacagcaagagattattacgatagtgaccgcagtttaactgagggcatgagtgaaaatattgctgatggcatggtattaggtgcagggttcgggggtatgacaggtggctatgaagctatgtctcatcgcagaaccatgaaccgtgagaaaaaacgccttttagaagcggtgaatacgggtgatgaacgagtggatgcacaaattcgttatcaagtagaagcctataacaaaattgccaatgatttagatgaactgatttcgccacaaagaatacaaacattaaatcaatttggcttacaagcggttgaaaaagctaaacgcagagagcaaattgaagcggaattaagaggggaaacacaagctcaagcagaaaaacaacaagcagagcaagttcaaacagtaaccgatacaccttaccatcaacgcaatttagccgatattcaggcggaatttatccagcatggtttagatgaaaatgattttaatgattttctagaagccaacttgcaacaagcgacagcagatttacaaaaacttcaagcaaacccatttaaaatggggacagatttgcaaaaaagtttagcagaaaagaaagcctataatgcaaaactggcggacacacaagcaagagtagactactggacacaggcaaaaaccgccccaaagtttggtactgaggctactcaagcagaaagtgcggttcaagcagagagtgaaattcaaacgcaagaacaagttaatcctgaggaattgaaattaagccgttcggccccacaagaaacgcaatcattctatgaaaccgaacaaggattaggtgggaaagagggtgaatttagtgcaaacaatgatgatattcggtttagcttgaatgagcgtgcagatagtgattttgctaaagcggttgatgtcgtttctcggggttatcctttatctcaacatgtcaaagtcgggacaactcctgaagttttgaaaatgttgggattgcctgatgttagagtgactattagcggtgaagtgttgcacaaagtaatgcaaggaaaacacaatgttacggctacaaccttaaaacaattgccaagtcaaatcaataatcctgttgcagtaatgaagtctgaaacacagcttaacggctatgtggtactgaccgaattgatagagcaagtgaacgataaaaataaacctgtgattgcggcgttgcatttaaaacaaaccaaacaaggtttagagttaattaatattgccagtgtttatggtagaagtaactcacaaatccagcgagcattagagagtaatttgctttattggaataaagcaaaaggttcgcaatttgtgactgccttcgggcttcaattgccttctcatatgcagtccgctacgaacctttctgtcgctaatattaaaaccgaaactgacttaagtcaataccaacgctcaacttctcgttcggcgatgaaaatagaaaaaggcaacttgttagaaatgacctctcgcgtatcaactgcggagatttctagctcatcgcctttatctagtatcaatgataaacgccttttgcagattttgcaacaacagactaaatctttcgactttagccaagaaaaatcccaaattgcagaagctgtaggaaaaggactatcaaccgcattttgaggtggtgcattcttctgaactaggtattaacgacccgactattgaagcagcttacaatacccaaacaggtaagattgttattattgccgacaatattcgagccaatgacattttaacacgtgaagagcgtttaaaatgggtagcgtggcatgagctggcacaccgagggctacaagtgcggttcggtaaagagttccaagccttgatggaacaagcagaccgaaatacgacagtgcgagatttagcaaccgcacttcaaaaagaccgtgtagaacttcgaaataatcgtaccttggcgatagaagaagcgatagcagaactgcacgctgcttataccacaggcaaaatggaagagttaaaaagccgttatggtctagttgttcctcgtggtagagaaataagcctaaaatcttggtttagaattaccgctgaacgcattcgagagtttatggtaaaacttttcggacgtgaaaaagcaaatcgttttagtcatgatgacttgcttaatttgttgaaagacattcagcaaagtgcgggcggcgatatacacgaagcggataataatacacgctattccttaaatgaagatccaaattctgattttgctaatgccataccaaaacgcacggcgactagctatgatgaagctcgttctattgtatctgaattactaggtgaacctttagtaaataaagaaacaggaatggtagcgaccatttcaagacgctctttagataagttgctaagtggtaaagcggtagataaatcaactaatctgaaagatcatttgacagctgtcgcgaatatcgatcaattatttgaaaatgcaattcaaggttgggttgaagcagataagaataacgatcctaacatagcaggagtgcatagattatttgcaccattaagtatagatggtcaaattagactagcaaaactaactgtaaaagcgatgagtttcaatcaaggaaatcgagtttattcggtggaaacgattgaagtagaaaataaaaatagcgatttgtctttatcttggaagccacagctaagtgaaaacactcaactgacttcccaacaaatcgctaatgtccaaagtttaatccaacgcattcaaaaattcaatagtggcgatcaaacttatcgcttttcacgttcaagcacttatcaatcaggcgataatatttccgtattggaactttctcgtggtggaaatattcaagcaccaaaatggacggataagttcagcacgcttcaagccttgaaagaaacttttcatcaaggaacggcaaaattggacgaatggtttgctgatagcttaagaccggtaaatgattggatagacaacatgcagtttagcgatcataccagcaataaaagtggtcgagaccatgaaaaacgacgtttaaaagacgcaatgtatacagcaaaaggaagacgtgatgctttaaattccgagtttgatgtgaattatttaaaaccgattttggcgaaaattgcagaaattgctaaacggtcgcagggtaaaatcaacgaagaaacggcaaaaagaaaagccggtttttgggtttccgcacgttattccattgaaaagaatatggagctattgagcattgatgaaaaagctatgcaagaggctcaaaaagccttagatgacgcaaaaatcaatgggacagtagaagatattcgcaaggcaaaaaatgcctttaattcagcggaaaaacactatcttgaccgtaaagcggcagtatggaataaagactttaacaacaagcactttaaagcaggagttgccggcggttggtctattcctgaagccaaagaaattatgcgtaatattgagcgtgatatttcgattagagatttaacgaccatcggtgatttaattgcggatttaaaccaagcacggttagaaattgattataagagcggtcgcttaacagacactgaatatcagcaatttaaagcgaaccgtcattatgtgccgttgacaggcgatccgaatgcacaattagacgacatggattttatcgccggtgcggggtcaaattcgttaaatattgccaaggataaagccttaaaagggcggacaaattctgaggcggaagatgctattgacgcagtttggaaagcggtaggaaaatcgacaacttatgccggttggtctgagtttaaaggaaaacttgatgcgttgcttgaaacggaagtaagtttgcttgaacagcaaggctatagcaatgtggaagcacaacgcctagccggtcaaaatttagggattggcaaacaaaaaatgcaaggactgacacgcagtagcgataatgtgttaattgcgagacgtggaggtgtgtattatgagtacagtttgccgaataacgtcattgctgccctgaaaaatgataatgtggagcaggcaaatgatttcctgaaagtgttatctaagcctacccgttggtatgcaagaggagtaacgcagtggtcattggcatttgctccgattaatatgctgagggatacatgggaaaaatccgaatttattcgtgtgcaaaaagtatatgacagacaaggtaaattgctcagtagcgataaaatggatcaaatcggaagagcgactgcactttcacccctaacaaatcctgctatttgggcagcaacgaaacgctttgcttttgggcaagaattgcgtgatagtgtgttagaagaaaagctattgaaacagctactcaaagagggggcgatttcaacatatggtacttatctcgaacgcacagaagcggatttactcaaacgcattaagcgagaaaatagcgtgctggggagtaaaatagacaaggcaatgggcgtgattgaaagttataatcaaactttcgatatggtttccgcactttctgcttacaaggcgttagtggataatggcgttgatagtaaacaagcagccgcaacaacattagaactgactaactttcgtaagacaggttcgaaaatgcgaggtattaaagccttgtatatgttctctcaacctacagtcatgggagcggcgaacttaattcgttatctttcaacgaagaaagggcaaatacgttttctgacgtataccgcaggaatgatggcactttatagtctcttgcgttctatggatgatgaggacgaggcggggaataaaatggatcagctgggtgatattacacgttttatccctattccaataggcaatggaaattatattaaacttcctgtggggtttggtatgcctcaaatggcgtggaattttgccacaaatattgtgaaaggtgcggtgtctgatatttcctttatggaggcaggcgtgaatatggttacccatgccacaaaaacctttgcaccggtttcgccatcggaaatttccgctgtgaaatacccgttggaaaaattggcactaacctttacgccaagcattttacaaccgcttatgcaaaatgcgttaaatcgttctgcttttggtagtcaaatcacgacaaattttgttcgccaagacaaactcaaggctgaacaatccaagtcgacgaccgcacaattttggaaggatttagcgattgatattcaacaaaccttaggtcttgatatgcaccctgaacaaattaaaaatttgtttgatggatatagtggtatgttaggttcattgaaggagttgaatacgtggcttgtggaaaatccgaaccgtgagcaattggggcgtaacacgagaacattgttcattaatcagttgtatggtgcaggtaatgaatttgcggtgcaatctcgttattatgaagcgagcgaagaagcacaacaagttgctaaggagtatgcttatcgaaaactcaataaacaattggatagggaatggctaacgcctgaacgccaagagttaatcaaatggcatgagtataacttgcgaaccatgggcaaattacgcagtgaaaaggcacaactcaccaaacagttaagagcgggaaaaattagtgcacatgcttatgagcaacgcctcaaacgctacaatgaagcggtaaactcggtacagaaaaaactgctgtcaggttatcgccaaatggtagggttaagcagttattgacctgtaaaaaaagcaaataaagcctgtgttaaacaggctttttcggcgtgtaataatgacttgctcatttctttttaatagattaaaatctataaaaaagataaataggcaatgtaatgcaacaagagtggaatgtgattttgcaagatcctgttttggagtggtttaaaacgctaaaacaagaggatttataaaacgatgatagcccttgctgaacaaacttatgaacactacctttcacaattagagcaggagtagcaaaatgagcaaaaactttaaagcattgatggcagaattaccgccggaacaacagaacaaggtgaaagaaatggctcaagaaatgagaatggagctacaactttatcgtattcgtgaagtgctggaaatctcacaacaacaaatcgcacaagcaatgaatatcaaacaaccctcagttgttgctttggagaaacgaggaaatgatgtgcggctttcatcggtgaaacgttatgtggaagccatgggtggagtgttgaatttatctgttcaacttccaacaggaaagacaatctcttttaacttgtagcattcataaagcgacataagatatagttgcctgatattttgcagaaattgccgagttatattttcaatgtaactcggttttttattggggaaaaacatgattcatttgtcctgtgagcttgaaaaagagcaattaaacactttttttactcggcgagtaaaagaatatcaacaagatttaagtaacgagggattaaatgcccagcaatataatattttgcgagggcaaattaaagaattgcaggaattaatcgctttactaaatattcattcaaactgaacctacccaccaagtgcggtaggttttttatttttaaccattcaataagccgctttatgccgctttaggagaaaacaatggaaaatcaagaacaccaagagttcaacgaagatgccgcttttgatgaagccgcgaaatcgctcgaaacaggtgaactgactgctgacagtttgccatctgatgccgagaaaaccgaaaaggacaagcctgatcagcttgaatccgaacctgaacaacaagaaaaggttgaacaggacgatttgcccgattggttgcaatctgccacagatgaagtgaaagagaatttccgcaaattgcaagcagataaccaacgttaccaacatcaagcccgttcacaaaatgggcgtgttggggcgttgacaaagaaatatcagcaagcacaagctgaaatcgaacgcttaaaacaagagcattcatatgcaaaaccgcagttaaatgatgagttaaaggcgttagaagatgactatcctgaatttgctaaaatgttccgcaaatttgccgaacatcaagatagacagcttgctgaatatactcgaccgcttgaacagctagcacaagccgaaatgcaagatcttgctcaacaacaactggagaacagtatcaactatgttagccaaattgtgcctgatgcggagcaaattttaaacaatccgcattttgctacatggttacaacgccagccagtaggtattcaagccttgttcaattctgatgaagtggatgacgctatttatctgttgagtgaatacaaaaaaaacatttccgcaaatgaagttcgtaaagcaaaacaaaatcagcaactctccgccctttctttaccaagtgggcgaaccgttcctaaaggtggggaagaggtggacgaggatgtttatttcaatcagatcgccgcacaacttgacaagcagcggtcacgttattagttcatcttaaaagaggaaaaattttatgactacaatgacaaaatattctgacattagcccacgtactacagtgtatgcagcagctcaaatgcttaatcatgcagagccgattttggtgttaaacaaattggggcaaactaagcctattccaaaaaacaaaagtcaaaccatcaaattccgtcgtcctaagccatttgctaccgcacttgctgcattaacggaaggtgtacgccctactcagcaaaaaatggcgtatgaagatgtcgaggtgtccttgaaacaatatggtgcatggacggaaattaccgatgtgattgaagatacacacgaagatccggtgttaaaagacattactatgctttccggtgaacaagcggcggaaactgccgaaatgttgacatggggtatcttgaaagcaggaacaaatgtgatttattcaactggtacagaaacaagtacggtaaaagatgtattaagcattaatcacattcgtgctgcggtgcgtaaattacagaaaaaccgtgcgaagaaaaaaacctccattttagatgcgtctattaaatatggtacgaaaccgattgaggcatcttatattgcggtttgtcatactgacttggaggcggatattcgtgcacttgccggttttacaccggtggctgaatatggttctcgttcaccgattgttccgcaagagtttggtacggtagaaaatattcgtttcattacctcgccattgtttaccccacaagaagatgcgggagcacagtcaatcgatgtagtatcgaaaagcggttcaaaagctgacgtgtataacattgttatctttggtcaagacgcctttgctacctgtccgttaaaaggcaaggaatcggcagatatgctgattcgcaatccgggtaaacctgaaaaaggcgatgagttagggcaaaccggctcggtgggttggaaaatgtggtgggcaggaaaagtcctcaatgaggcttggctcgtccgtattgaatgtgccgctaaaaaactttaacccaattatcacaagtagccccatgtaaaagtggggctttattctttatgaggaaattattatgtcttatccatttatttcatttaattcgacagtagaacaattaaaaacacatttacgtgaacactgcggtatcgaaaaaagcggtagcaaaaaagaactgattgaggcaattttagcgtttgaagaggaaaacggattcgtgcgtccaaataaagacgtggcagagcataccgctcctgtgaataaccttgaattacctttagaaaagcaacgaaaagtgcggattaaaattgcagaaactgagcaagatcgcagtgatgtttatgtgtctattaatgattgggacgcattgattaaacgaggtgtagaagttgttgtgcctgaggcggtgtatgttttattatcaaaagctggcgatcaaacctttacgcaagaaaaagacggctcactgacggaaggtttcagtcctcgctatcatgtgactttattaggttatgaatcatgaattttttagcgttggctcaacgtttacgccaagaaatgaatgattccggtgaaggacctgcacaagtaacgggacaacgagggcgaaatttagagtatgttaacgccataagagaagcatggcttgatatacaacaatgtcgcccttgggctgtttctttttggcaacaaggctttagccctgataaattacagatacttgaaaacactgttgatacgccgttcattcctgcacaatatcatcttgcaatcgtattttatgcgatgcaatccaaagccatttcacaaaatgcacaagaattgatattgcgaggacagcaagaatgggacaaatatctccatttactttgtcgggactttttgccgacgttgaaagtaggtaggtagacaagctatgttgattattttagaatagccatattattccattttatttgaggtttttatgtcaaatcctaatgctccctacattcgggaaattgttgatcgctcacgcctaattggtggaacagcgatccaatctcaacggaaagatgacgtaaaaaaagccgttttacaggtattttctcaacaggcttaacggttaaactaatttgtcaaaaaaccccgacttgttcggggttttttcttgcctattttcaggagttccaatgaaactaccgcaaattcaatcacagtttgttgcgataagtgggggtatggatttaaccacaccgcccattgttaaagcaaatagtgaagctattattgcgttaaatgtacaacctaattacggtggcggattttctcgtattgaggggtatgaatgtttagacggtatgactaccccctctttaatgaaccattttcatgtgaacgttaatcacgatgttccacaaagtgcggtcggaaaacagtttttgttaaatgaccgcacttgttatgtgttagcagtgaatgaacgttgtttaacctttgccgtttcgggacagtttgaggttgatgtcggtacaacctttgaccttgataggcaaacctatcaaaccatctcaaagacttttttgaatgaaggagaggtcaaacaatggcaacattaccaagcactggcgtttcaagcgggagtggacaatgtgcaagcggtaccgggtgaaaatgccttgcgtggtgttgttgaacttaacgagcaaattatcgcatttcgagatggggaaaatgcttgtgaggtttttttagcgaccaaaacaggttggcaatctgcacctgccacttattttgttgagcttaaagacatcagcaagccaaaagaatttattgacggtgtgaagtttacttccggggaaaaacaaggaaacgtattttctgccgtgttgtcggctgatgatagtagcggttatcttgtggtcaatactgctcttttacctgcagcagaaattcacattaacggtagtgttgcggctaaggtgaaaagctgtgaagcggtcagattgacaaaggaaaaggcgtggacatttatttatcataatttttatggtggtacggaaacggcttatgcttacggttgtaacggtgaacaggtaattgaagttcgtcctgatggtattatcgtaccgattataacccaagcggaaaatcctcaatatattgttgcacatcgtaaccatttatttatcgccttttcagggggacaattcgggcattctttagtgggcaaacctacgcattgggcagtattgctcgggtcggaacattttggtgtaggcgatgaaatcacagcactgtcttctaccacagggggcgtactgttaatcggttgtcgccataaaaccaccgcactttatggctcaacacgtgatgactgggtattaaaagatattgccaaggtggggattaaatcaggtacgctacaagcaacctttattccgattgccattagtcgacatggtattattcgtgtcgatgcaacggagcaatttggcgattttaaattaagtgaaacagactccggtcgcaaattgggtttcaaacccattgaaaataatattgtcttttcttccacaaaagccaaagcaaaccaagtgcggttttattcggagaatgcgtttcatatttgcatgatgttacaaccggacggcagtacaaaaagcacctatttcacttatcccgaaaaactaaaaggcgtatggcaatctcatcataatacgtttttagcttttgatgacggcaaagtctatcgtcaatcggatgactgtttttcttttgcaggcaagccgattgaatggacagtgaaaatggcatttaatcactgcggttcgcctgtgcatattaagagctggaaaagtgcggagttacaagctaccgcacagggtgttttgtctgtgcaatatcgtttcgatttggattataacgctgattttcatgcagtaaatcttgcacaggcgttatccgttattggatatggtggacgttggaacgaaagttattggaacgactttttatggtctactcaggaatattctacccccgtactttatttatcgggttacagtcgaaacctatctttatcttttgccggttcggatttatacgcccctcaatttgaactgagcggcttagtgttaaactatattttaaggagatttcatcgtgtctaacaaactcagaaattggtacaaaagaactcatgattttgcaccctatactcgtgctgacggaaaagcggtatcagatgaatttgatgcaatccaagcgagttttgaaaaaattcccgctatgcgagatgatggcttaggttttgcggaaagccctgttattcccgacccgacacaggataaccaccctgtacccttacatttgttaaaaacggcggaacaatcggtttatgcggcgagggataaagtgacagagcttgctcaacaagttacagacaacaacgcaacaacggagcaaaatactcgtttagctattcaagccaataaacaagcccaacaagccaaaacagaggcaagccaatctgccacacaagcgattgacgccaacaaccaagctcaacaagttaaaacggcagtacaaaaagcgaaagagaccgcagtttcttcaatgcaatctgcggaacaatcaaaaaatcaagcaatacaagcggaaaatttagcgaaaaaatgggcgtccaatcctcaaaaccaaatagtacaagaggggaaatactctgcttatcattacgctctagaagcagaaaaacacgccgaaaaagtcaaagcgaccgcagagggacgtaaagattggaattttattgataatgtccctatcagcaaagatattaacgatagctcagagacaaaattagccagtgctttttcggtcaaaaccgcttatgacaaagcggttgaagcggaaaaaatagctaatggcaaaagcaattttaaaatagaacaaggcaaagacaacgcagacgactacaaaaccgacgggcactattattttgcgagcggtcaaaatttgcccgataacggagcgtggcatgttgaagtggtgagcggtgggcaagctaccgccgtgcgacaaattgcacgcaaagcgaacgataccggcgtcaaaactcgcttttttaatggttcaaattggacagcgtgggaagatttgaatgtttcgggtttatttacctatgaaaaaacaggtaattatgagaattatatagaagtccgccaatacccagatggaactatgatacaaacaggtagagcttcgttgatatatacgcataaaacatattttttatacaaaaaagtcttttttcatgttgcgtttagtgagccaccgttaatcttcaccagcctagtcaagccgaattctgaaaaatatcaaatctaccgtaaagacgaattaaatgtaaatgttatctcaacgaagattaatgaaacaggatttggaatcaatttagttgatgatgacgttcatgattcagaccccgaaataaaagttgactttatggcgattggacgttggaaaccgagccaatttagtttctaaaaatccaattgcgtcgcatgaattcctaaagcaagggcgattttttcccttgtggcttttcgcaagtgagatgatttttcatattgactatatgcagattgagtaatatttaaacggcttgccatgtctttttgcgttaatcctaaatgctcacgccacgcaacaagtgcggagcaattattttctaaggcaaaagtcgctacagcaaaaggcacgccactatctaaaggagaggagagttttgcctgttgttttaaccattcaagggtagcaatgggcatgacggcaaaagcagggtgtccgctttcatcatgtaaatattgaatgttagtaagtgcgttcatctcgttttttcacctcttcaatggaaataatattcatcatatcgccggcaatttcaaagaaaactcggtaatcgccaaccctaaaacgataggggtaacgatgattaacaagggcttttacattagaacaaaaaggaaaatgcgttaattcttggcattttcgtgcaattttcgcccctgttggaatttttcttaattgctttaacgctttgggttggaaaataaccgacttcatgaataaagaatataagttaaatataagtttattttagcaaaaacaacaaccaaggacaacacatgaaaatctacttcaaagacggcttttatatgagccacattcacaaaaatattccccaaggtgcggtggaaatctccgaagatttataccgctctttactggtgggtcaatcagaaggcaaacaaataatcacagatgaaaacggttatccgcagttagccgacccgcaacccagtccatttcatcatattgaaaaggggcaatgggttatttcgcctgaaaatcaaaccgcacatttaacccaagtgcgggcggaaatgcgagagaaaatcaatgccttgcgagatgaaaaaatcaatggcggggtatttgtggaagcggtgggcaagtggattgatacggacgccacggcggagcggaatatcttatccgtcaaagccagttatgatttattcggtgatatggaaattgcgtggacttgtgcggataactctgtattgatgataaataaggaaaaattaatgctgatttggcaggcgttaatgaacgctaaaacaagtaatcatgctaatgccttgaagcataaaaccgctatggagcaatcggacaatccggcggaatatgattattcggacgggtggacaaccagttatggggagtatttgaaggagttgaaagatgagtaaattaaaatattggttttatcatgttttaattgccgttgaccaattactcaatgctgtttttggcggtgcagcagatgaaaccttttcaagccgttgttatcgtggtgcggtgttggcgaaaaaaccgaaaaaacgttggcgagtgatgcattttgttattgaggggcttttcttttgggaaaagggggagcattgcaaaaatgcgtatctgtcggagttaaagcgtaaacaatatccagaggattttagcagtaaaggttagtcaatctattatggctaaccgtctaaaaataacaaaaccgctttgtattttaatatatgagcggttttgttttgtgtgtcataccgacttttcggcatggcttttttctataacaagaggacaaataatgggcattttaaattcgatgagtgacagtttgcaagaccccaatcaaagaacgcttacgcaaggcactacaacagcacaatctaaaaacattaatcaagcagtaccatcaatggcacaaaatgttacgaataatcttaatagtaactcgttattaatgaaaagtgcggcacaaaaaggcaatcgaatggcggcacaaagaggattgcaaaattcaaccatagggattgagtctgctcaacgtgcgatgcttgatgcggcgattccgatagctcaacaagatacgcaaaatcagcaacaaataaccgtagcaaacttgaacgctaaactttcacatgataacgcaatgaaagagttgggtgctcaagtgtcggcgaatacaatcggcaaatctattgattatgcaatgcaaattacaaataactttgacgctcaaattgctggtgtgctgaataatacgcaaatgaaagaggaggataagaaaaaagccattgagcaattgaaagcaagtcgagatacggaattgagttttatgagtaggtttatgcaaaaaattccgacgacacaaaaagattgggcggcattcccgtcattgggcgtaccgacaatcacaatgaaaccaacagaaacagggggtaaagtatgagtttttgggattcagcttggagcgtaattacagagtctgccaaatggatggaaaaaaaccaagcggcaacaaatttaatgggaagtgtactacaaggaactgcgggctattttcttcaaaaagagcaagctaaaaatcaaatgcgacaacagagagagttgctgaatttgaaagatgaaatgcaatcaaaatattctgcggtgccggaagtagactcaggttatggtgggcttgtggttgatgagacacctaatttggcgaatggcggtattttaactgaaatgaaaaaaaaggtagatagaaaaggagtgtagccatgggatttataaatgatgccggcggtggtacagctagaaatattcgcgatatagatagagacagagatagagggcgtaataatagctatgatacgcaaagtatggataatttagctaaagctattcacgacggctcttatcaaggaaaaaatgatagcagatggtctcgtcgagacaaggacggctatagttcattcggtcgagatagggataatgaaaagtatagcaactatgccggcagttattctaaaggaaaaagtgcgattggaagtgcggtacaaaaccatcgaaatgtagtagctaattctccgtccgatctcaaatcaaaaacgctaacgggtgaaaatattgatgatggtttgttgtcctcaaaccaaaataagcaatatagtccaattgactatgctgaaatgtataaaaacggacctcgtcatccgatagaaaaagcaacgttgggtaagcgagaaatgggaccgatgagccgaattgcacctgaagatccacatgctaacagctatcaaaactacagatatgtacaatccttagcgaataaggattggatagaagatacgcaacgaagcatagccggaaatgcggttggcggaatatcttcctccggagtggctaatgcggttgccggtgctgtagggggcggcttaggcagggctgtagccggagcagtagcgggaatagcagcatctaatgccggagatttggctaatatggcagtaggtaaagccaacaaagaaggattaacagatgaacaaaaagcaatgtacgatcaagctttctcacagagacaggattatttcgacaagagaagacgttcatttgatagtttcggtaatggtatagcgactgttcttggcaccggtgtcgatattgcttcaaaagggctaaccatgggggcaggctctaccatcgctgatgcctacaaaaataattcggcattggagaaaaccttggaaaattttgatagccctgaaaataggcaatttttaaaagaaagacaggaggcgtacaagcgtgcaagggaagaagatgcgaaaagacgcaaagcagatgggtcaaataaaggcattctctacaatatgactaaacgtctacagcctcaagaagagccacaagagccaactttaccttactatgctattccggcattaactaatctttggaataacgtcattgtgaaataaacaacaggagaaaactcaatgggtattttagataatatggcacaacaagccaatgcacaaccgcaaatgcaacaaacggcgacaccaccacaaactgaacaaacgggaaatatgatgcaaatgtatcaattcttaatgcaaaactcaatgcaagccatcgcagaaacggcagagcaacgcattcacgaaaaaggaccggtagacggaacggcagatttaattgcaaccgcaatggtttcaaatcttcaagcggcacaacaaaatggtaaaaccatccccccacaagtcatgttacaggtcgccaaagatattgccatgcagttattacaacaaatgggcgtaccggaagagcaacttgatgatgtattgattgacgttttatttaaagcgttggatcaatttggtgaaatgagccatggcatgttatcagcggaagaagagcaacaatatgtcgacatgatcaacaaaatatctgaggcggaacagcaacgccaagcacaaaaaggcgaaaatccgaccgcacttgaacaggcacaaacgggaggtatgtaatgggatttggcggtattttagcctcaattgctcatggattgggcggaggtatgattaaagtcgcggatgagggctggaaaaaagaagcagacgagcgtaaaaatcaattctatgcagatcaaaaagcattagatcgagaggctgaactaattctattagacagaaaacatcaaaatgacattaattttttgcataagaaaaatgcgatttctcaagcggttaacaatagccctaatatgaaagcgatgaatgaaatcaaagacgcttttgatgcaatggacgcaggaaacaaagaaattgcacgacttgatgaattattagcggataaatcactttccaaagagcaacgagaaaaacttacaacgcagagacaggcaatttacgatcatgtttcttcagtagccaacaacgaagaaatttggaaaggaattcataaaggcagatatggtcaagcaatacgcggcaaacatattcaaatgactacaccatacaaaaagacaccatctccagtggctgtttcgcaaaagcaagccaaccagcctataattgtaccaaaacctgacaaagctcagttatacggagaagatattatgaggagataccacaatggagaattactagactagcaaaaactctaaaaacaaaccgctctttggattgaattgaagagcggttagaatttattttgtaagctgtatctttgcaagatgtaatggtagttaatgagatgtgaaaatgtgacataaatgtgtcataaaaggtgaaaaaagatagtaaaaggcgtgttttttataggagggtgttctttgattagctttgtaagtctttgttttaaatgttgtttttgttttatttggtttttattaattgctcttctaagccgtaggtcattggttcgaatccaaatagggcgtgccatttcttaaattcctctaacaaccaactaactacagctccaatgatctaaactaacgacagcttaaaaaacaagtattttttgctatctcaaaacaaagtattgtatttatatacagtataaattatgatctaaaagaaccgattacagaatttaactgttaccaaaaactgatccaaaaacaaaaaaagtgtaccaaacagcagaattaaaacccaagccatgtctaaaaaaatcacccaagcaaggcacatgaagctacgccgccaaaaagacggtatagaactagggtttagcggaaataccgcctacatcgccactattcatcaatatggattaagagcaagagtagaacgacacaaagaacacaaagtacaatacgccaagcgtgaattgctcggctttacggaacgggacaaagaaatgattgaagcgtttgtgattaaggcattgagtgaaaatattgattagatgtcatcatctaaattcttatttttgcagtggcaacaatttttatcacgattggacgtatcataaaacaacacaaagataaaaaataaagcaacactgccaaaaataaacgtcagcccaacgcttaaatcaaaataaaaataacaaataaggtaaggacacgcgacaattaacacaaaaataaggtcaataaaatcattaacagtcaatttacttttcatagaaccaccgtagtttttgtcgttattgtctttttatattaaaaaatagcaaataaccgcaataagaatgatggcacttatgccccattcaaggctaaattgataatcgacctgttctttagcatgataacgtccggatttcttttgaattgccattagcactgtatccaaaagtaacatcaaaggcgttaatgcaaacgtgaataacacgcaacctataccgacagggatagaaagcaaaaaaacggaaataagcaaggaactgaaaaaatgaatgacagataaggtttcccaactcatccttagcgaaataccaaacaacacaataacggtaaacatagcactgatgtagtacaaatgagtaacccaaaaaaaagtaaaattttcatactttaattcatcgtgtcgcataaaaacccctgtgttttttgtgtatctttgtttattttttctacgttgtcaatcttatttcaacatattaataatttgttctcgagatcggacccattcataaatcactgacaaaaatagttttggccagcattgccggttgattatcatccatatcagcaaataatgtggcaagtttttgctgtgctgtgtcataatcaccttggcttaatgcgttgatcactggattcaatattgggttcattaattgttgatatttctccggtgtcggttctaatccgtctaacacttcatcaggatcattttgtaccgataataacgctattttccctttgcctatcttttgagccgacaaaagtacggtcatatttggcggtgttttatgctcgaatacagcttcgttttctgttacggtacttgcagtttattcgtataaactttgttgatgttcattaggtctggttttaaatcggcgatgtaaccacatatattgtgttacatcttgcaatatttccttttctacaatcttattcattcgtgtcgctattgccgtttcatcatggagaatatccgaaaaatcaataggtgctgaaatgttcaacgtatatccagagttatctttgttacgaagcggtgtaaaagggataactttgctcttaggtgatgattttattaagtagtaacttccggttgtcgttgccgcctccggtacagcaaaaaaaggtacgaaaacagcattttttcttccataatcatgatccggagcgtaccaaatcatttcaccatgacgaatagctttaatcattgcacgtaaatctttgcgatccaataaacctttatttgatcttgcacgtccacggcattgtaaccaatccattaaaggattatcatgcggtcgataaatgccaatgcctggatgagatagaccaataatccttgcacctaattctaaagtgagaaaatgaatacctacaagaataataccgtcttgttgattttcttttaaatattcaagcccttcaattttgctccatttttttattcgtttatctgaccaaaaccaagccataccggtttcaataattgccatgcctgttgctttaagattggattgcaatatatcgttgatttcctgttcagaataatgaggaaaacagagctgtaaattttggcgagcgatttttgttctgcgttgaccgattttcaaatgagaaaataaagaacctaaaccgttgccgattttaagtaagattggataggggagcaataaaataagacgaaaaaataaaaaacctaaccagaaaagccagtatttaggcttaagaaattcaatattaaattgtggaattgatgtttttgccataatgttacttagtctaatacaactttgattttgcgttgtagtttaacggaaatttgacgaaatagcatttttactgtggtaaaattagcaaaattttagtgattttatgagagaaaagaaaaatgatgcaatattcagcacagtttaatcgagctaaagtactggtgatcggtgatgtcatgcttgatcgttattggtttggggcaaccaatcgaatttcacctgaagctccggttcctgtggttagagtacaagaaaatgaggaaagagcaggcggtgcggctaatgttgctatgaatattgcctcgttaaatgtacctgttcggttattgggtttaacaggaaaagatgaagcagctagggcattaatgcagctattggaaaaacaaagtattcattgcgactttactcaacttgactcgcacccaactattactaaattacgtatcctatcacgtcatcaacaattattacgccttgattttgaagaggatttcaacaatataacaagtgcggatttattgtgtaagcttgaaagtgcggtacgaaattatggtgcattaattttatctgattacggcaaagggacattaaatgatgtacaaaaaatgatccaaattgctcgtaaagtgaatatccctgtcctgattgatccgaaaggaacggattttgcacattatcgcagtgcgacgttattgacgccaaatatgtctgaatttgaagcggtagtgggtaaatgtcatagtgaagaagaaattgcagagaagggcttgcagctaatcaaagagcttgatttatccgctttgctggttactcgttcagaaaaaggaatgacattattacgtccaaacaatgcaccatttcatttacctacggaagcaaaagaagtgtttgatgttaccggtgcgggcgataccgtaattagcgtattagctaccgcacttgctgacgggcgtagttatgaggaggcttgttatttagcgaatgtggcggcagggattgttgttggcaaattgggtacatcaacagtttcaacagttgagttggaaaatgccattcatggcagaaccactgcaggttttggcattatggaagaaagtcaattaaaagcggcggtggaattggcaaaagcacgaggagaaaaaatagtgatgacaaacggttgctttgatattttgcatccaggacatgtgtcttatttagaaaatgcacgtaaattaggtgatcgtttaattgtcgctgttaatacggacaattctgtaaaacgtcttaaaggtgaaactcgtccgattaatgatttggcgactagaatggctgttttggcgggattatcttctgtggattggcttgttgcgtttgatgaagatacacctcaacgtttaattgcagaaatattacctgatttattagtcaaaggtggagattacaagcctgaggaaatcgttggcagcaaagaagtctggctaaatggtggcgaggtcaaggtgttaaattttgaaaatggctgttctacaacgaatgtgattaaaaaaattcaacagttaaaagagtaagggaacattatgattacggtatatggtattaaaaattgcgatactgttaaaaaagcattgaaatggttagcagataacaatattgaataccaacttcacgattttcgtgtagacggtttacaacaatattggctagaacaagcggaacaacaatttggctgggaaaatttagtcaacaaacgtagtacgacatggcgtaatttagatgaagaaatcaaacaaaatctgactaaacagaccgcacttaaaaccttacttgcacaacctactttagttaaacgtccgattattttacaagacggcaaagcgttgattgggtttagtgtagaagattatgaacgtgtattgaaataaaagatcaacaacgttctatttaacgtatggcatattgcaatagtgcaaaatgaaactatgaattgataaaaggacagatgctacgcaaacgttcgtaaaaaaataaaatcttatgaaaaataacataattactctcactcaaagtcttattcaacgtccttcaattagccctgatgatcaaggctgtcaacaacttattgccgaacgtttacaagctgttggttttaagttggagtggttaccttttggtgataccttaaatttatgggctactcatggtgaaggaaaatgtattgcttttgcggggcatacagacgttgttccgattggtaatgaaagtcaatggacttatccgccttttgaagcccgaattgttgaaaatatgctgtatgggcgtggtgctgcggatatgaaaggtgctttggcagcaatggttattgcggcggaaacttttgtgaaacacctgccaaatcatcagggaaaaatagccttgttgattacctctgatgaagaggcagcggctaccaatggaacggtaaaagtagtggaaacgctaataaaacgtaacgaaaagattgactattgtgtagtaggtgaaccttccagtgcaacgcaatttggcgacattattaaaaacggacgacgtggttctattacaggaaatttgtatattcaaggtgtacaaggtcatgtggcttatcctcatttagcggataatcctgttcataatgccttgaaattcttagatgaattaactcattatcaatgggataaaggtaatgaatttttcccgccgaccagtttacaaatcgccaatattcatgcagggacaggtagtaataatgtaatccccggtgaactttatgtgcaatttaacttgcgttattgtactgaggtgacagatgaaattattaaaactaaagtggctgagatgttggaaaagcataagttaacgtaccgtatagactggaatttatcgggcaaaccgtttttaacacctcaaggaaaattagtaaatgctacaattgaagcagtgaaaaaatttactcaaatcagaccgcacttagatacaggcggtgggacttccgatgctcgttttattgccacaatgggagcggaagtcgtggagtttggacctcttaatcaaaccattcataaagtgaatgaatgcgtgaatattgatgatttagccaagtgcggtgagatttattattatattttggaaaaattgtttaatgaacaataggttatcaaaaatcctcacaggaaaaagtcgtgaacatttaatttcattaccgaatacgctttcggctaatcattttttgcagatggaagttgtcgctgcttttttgcagttacagcaagctgcaaagcaagctggctttaatttacagccagtaagtagttttcgtgattttgaacgtcagcgttcaatttggaatacaaaattttatggagaacgtaaagttcatgatgatcaaggaaatccgttagatttaaccgcacttgatgattggcaaaaagcacaagcgattttgcgttggtctgctatacctggagcaagtcgccatcattggggaacggaaatcgatatttttgatcctgatttattgccaaaaggacaatctttacaacttgagccttgggaatatcaaactggtggttattttcaacgcttaactaattggttattagttaatgcacaacaatttggtttttattttccattttttgagttaaaagataaaaaagtgggcaatgaactttggcatttaagctattttcccattgcagatatatatcaacaacaattttgccctgagtttttatcacaagcgtggtacgaggaaaacgttgcgggtagcgagatattattgaagcatcttgatgaaatatttagggattttttgatttaatgatttaagctatttttagccaatccaatttttaataattttagaggtatatatggaagttcagcaatttactcagcaagatattgaaattcttcatgaagaaacattgtacaaaggtttttttcaattaaaacgcattcaatttaagcataaactgtttgctggtggtgttagtggagttgtaactcgtgaattactttataagggagcagcatcagcagttattgcgtatgatccatatttagataaggtgattttagtcgaacaagttcgcattggtgcttacgatcccaaattaaccacatcaccttggttatttgaattaattgcaggtatggtggaagagggagaaaaacctgaagaggttgcactaagagaaagtcaagaagaagcaggcgttcaagtagataatttgcaacatgttttaagtgtgtgggatagcccaggcggagtgattgagcgtatccatttgtttgccggaaaagttgatagtacaaaagcaaaaggtattcatggcttggcggaagaaaatgaagatattcaggtgcatgttattagcagagaaattgcctatcaatgggtctgcgagggaaaaattgataatggtatagcggtcatgggattgcaatggttacaactcaattataaaactttgcaacaacaatggttataaaatgtgatacagattatattttttataaaaaattagataaaaatatgatcctgttaacattttcattatttttttaatgcaattttttattaaaacagtaagttataacccgtttgttgtatataaagggtgaatattttgatcagtacatatcaataccctacttcagagaaagtagttcgtttaattcagattaccgatccccatttatttaaagaaaaaaatggagaattacttggcattaatacgtatgatagttttaatcaagtattaagcgaggttttacaaagtaaatttgattatgagcttgttttagcaacgggagatttagtacaagatagcagtgaagaaggttatcaatattttgctgaatcggttaagttgttgaataaaaaagttttttggattccgggaaatcatgattttcaacctaaaatgtttgatgttttaagtcaatatcaagaatatatttatccgacaaaacatgtattagtgggaaaaaattggcaaattttgatgttggatagtcaagtatcaggcgtacctcatgggtatctaggacaatatcaattggattggttgtcagcaaaactgagagattatccaaaacgccatgccttagttgttctacatcatcatattgtttccactaattcggcttggttggatcaacataatttacgcaattccttagacttaatgcaagtgttgttaccttttagaaaagtgcggggcattttatatgggcatattcatcaagcaatggatacaaaatggcagggatataaaattatggcaacgccttctacatgtattcaatttaaacctgacagtaatcatttttctttagacacatcacaaccgggttggcgtgaaattgagttatatgatgatggacgaattgaaacaagggtcaagcggattcaacagaccagttttctgccgaatatgttgagtgagggctattgatgaaaagcgaaaagtgcggtgaaatttttgattttttcaccgcgctttgttgttcaagtcatcacaaataacattcgctagaatttcatttctaatgataaagcaaaattacgtccagcagcagtaaagcgttctaacccttttccgctgttatatacgtcgcccaatgcaccattctctttgatttgtcgtaatgtatcccaagtggtgtacttacgattgaataaattaaagatgcctgcatttaaggtaaaatgggaattgaggcgatattgtgcggttaaatcaaatacgacataagaactgcttaaaaaacgataaggtttgggttgcctaaagtcggatacaacacctgtttttttatcaacatccaattgcaagctatttacattcggaatatcaatagcgtctttggcttttttagcactgacatatcgcccgctgaagagaacattccatttgtcgttatccgcttggtagcctaatcccaacgtggtgctaaaaggctggattggtaacatcgccgtgccattatttttacgcccttttgcatagctggcttttaatatggcgtaccaagatttggataagccaactattttcccgttagcacgggcatggaaatcaagaccggtaacatcggctttatcaatatttatctgctgataatttacgccatctaaataatattcagtatatttcgttataggcttggttgcccagttagttctttgacgagagccaatttttggttttgtttcgacatcaataaaatcccgatattttgtataaaatacagccaagcttaattgatagttgtcgccttctttggtaagagagagttcatgattttgtgctttttcaggttttaaattaatattaggtaaatattggacatcacttgccccttttaaatcaaaatacatttcttctattttcggtgctttaaaacctgtgctgaattcatagctaagtaacgtggaatcggtgagcgaataatttaatcccaacgaaaaattgaccgcactaaattgtttcttgggtaaaacttcgactttttgactggcaagatcatattttaatgcacttgtggtgggcttatagcgatagtgatcgaagcgtattcctgcatttgctccccatttttgattaatactgattaaatcctgcacataggcataccaagcctgacgggcaacaggttgctgaatagtgaattcacgttgttttatccttgaataagcaccatactcttgatttctattttctaatttaccccaatgataacccaatccacctgataattgatgatgagcaaacttgccggcaatttcattggcaataaaagaaacatctaattgataatgcttctgttctgttttatataaacgcttgtcagtaataatattataatcttgcggagaaacaccatattgattggaattagcctgttgtgagactttttgttgggctaattgtacgctaaatttatttagccagctttccgttggggtataattataggaaagaccaaatcgctgataaggtgttatatcgcccgcttcttgacgatttgaagcataaaaacttttttctaaaatttttctgctttgctcaagattttcaaaaaaaccttgcacaaaatgttgtggagtaaaatgatatcctaattttgccaaccaagatcggctgtgataatccacattatcaggtaatacacgactacgcccacataattggggaaagatatctcgctggtctccatttggtaaaatgccacaatacgcaacgtcttttagtttgccactgtagtaatttttgttttcatgtgcatggcgataggtgtattgcaacaatccctcggcgttaccctgcttgaacccccccctatcacttggcgatattccgtattacgtgagctataggcagttttagcataaaatccaacagttttattcgagtctacaaaatcatgcacattttttgttcgcatcgacacgctaccgcctaacgcaccgctaccttgtgttaaagaattcgcccctttattaaattctacactacttaagttttcaatttccgtgctgttgcgattaccattataaaatcctttaatatagtaaaagcgaggcatataactttcgaccgcacttattccatcaacactcatcgccacacggtcgctttctacaccacgcatagtataaccattggcaccgccacgccctccttcagtgactgtaacacctgtttgccaacggaccaaatcctgttcgttccataccaaacctcgactaatttgttggctatttgtgcttgaagttttagccgatacttgttctgtttcaacaataatctgatctaatgtagcagaatcattaaattgagcgattgcattaaatgaaaataaaggtaacgtaacagcagaaaaccgcagtaacgtttgctgacgattttgatcaaaaaacataacacccctcttaaaaataagaatcaatcttattaatgataacagagatattactatatcgctattccttcttttatttatctaattggagaaatagaaacctttaaaatagcagaaatataaaattagacctttttcttactaatggtatctatccatactgctagtaataaaatgccaccttttacaatatattgccaaaaagtcggtacatccagcatactcattccgttatccaataaggcgatgataaatgccccgattactacgccaaaaatactgccgataccgccggctaaactggctccaccgataacacaagcagcaatggcatcgagttctgcattttgaccggcagatggagctccggctcccaaacgggaacttaaaattaagccggctattgccactaataagccgttaagagcaaaaatggttaatttaactttttccacggcaatacctgataggcgagctgcatcaatattgccaccaattgcgtaaatatgtcgaccaaatgctgtttttttcgaaatgaatgttcctataatggctaatccacagagaattaatactggaattggcatgcctcgataatcgttaagcagataaattgcaccaagaataaggattgctatcatgccatatttcactgtttctttgggcattttggcaactggtaaatttaggttttgtctggctttacgctgataacttccccaagcaataaagcaaaatattatgatgctccctaaaattatccctatggtgtcggaaagataaccttgaccgataattgtcatatcattactgataggggaaacggtagtaccattcgttaatccgatcaaaattccccgaaatgcaagcattcctgctaaggtaacgatgaaagatggtactttttgataagcaacccaccaaccgctccacgccccgattagtaaacctaagagcaaggtaacaaggatagttaagggtaacggccaaccccaccaaacattactaattgccgcaaagccaccgagtagccccattagtgaaccaactgataagtcaatttctgcagagataatcacaaacaccataccaatagcaagaataccagtgatagcagtttgacgtaataagttagagatatttcttgcacttaaataagccccttctgttgcaattgagaaaaaaaacataatcaccataatggcaatcagcataatatagacttgtaaattgattgatttgaacttattcatagcttactccttaagtgcggcttccattacttgttcttgagtgagatgatggttgattaaatccgctttaactttaccttggtgcattactaatacacgatcgcttattcctaaaacctcaggtagctctgaggaaattacaataattgacattccttcctgagctagttggttgattaatttatagatttcatattttgcaccgacatcaatacctcgagtcggttcatctaaaatcaaaatgttaggatgtaataatagacattttgctaaaattgctttttgctgattacctccacttagccggcctattgcgagttcaggcgaggaagttttcactttcagtttggcaatagattgattgataatggtttcttccagcggttcgttaatgacttttttaccaaagcagaattgagacaaagaagataaggtaatatttttacctacgctcataataggaataataccgtgttttttacgatcttccggtaccatgacaatatgatttgcgatagcttctgcgcacttgttgattttaactttttggttattgagaaaaatgttaccttggtattttcctacataagaaccaaaaatacattgagccatttcagttcgccctgaaccgactaatcctgcaacaccaagaatttctcctttccgtaatatgaaattggcattatcaacgcgtttaatatgtgtattggttgggtgccacgcagttaaattttctacgcgtaaaatttctttgccaatatcgtgtggctcgtgtggatacaatgaggtaatttcacgtcctaccatcatggtaatgatgtcatcttcgcttatcccttgtgctaattgagtgccgatgtgttcaccgtctcgaattacacagatcttatcggaaattgcttttacttcatttaatttatgagaaatatagatacatgcgatattgtgagcttgtagacctttaatcagattaagtagaatgtctgtttctttttcggttaatgaggcggtcggttcatctaaaatcaataaacgaacttgtttattcaaggctttagcaatttcaactaattgttgttgccctaatcccaatgcactcactttggtatttggatcaatatcgagctgaacctgctctaataaggttttacaacgcagatacattttgttgtcattagtaatacctgcttgggtaatttcattccctaaaaacatattttccaatactgacatatttttcactaaagtcagttcttggtgaataatcgaaattcctttttcttccgtatctttaatatttttagcggttaatttttcaccggaaaaataaatttctccctcataatcccctgagggataaataccacataatactttcattaaggttgatttacctgagccattttcaccacatagagagagtatttcgccggtttcaagggaaattgaaatattatttaatgctacaacatcaccaaattttttagtgatattcttcatctctaataatttcgtcataacttcacccctttttttagtatggcaagacataaaatcttgccacataaaatattttattatttataaacagcctctttggtatggaaaccatctttaatcaccgtgtcatcaatattctcttttgtaacgacgacaggctctaataggaatgcagggacatttttcaatccgttatttaattgagagttggattccacttttccacctttacctaacgcgactgaaatttcggctgctttatctgctaaattagtgattggtttgtatacggtcattgtttgtgaaccgtcaagaatgcgtttgattgccgctaaatcagcatcttgacctgaaatcgctactttgcctgataagccttgagcacttaatgcttgaattgcaccaccggcagttgcatcgttagaagcgactaccgcatcaatattgtttttgtttgcagttaacgcattttccataatttgtaatgctttttcagctagccaagaatcaacccattgatcgcctaccacgttgatttcgccactgtcaatgtgcggttgtaatactttcatttgacctttacgaaataattttgcgttattatcaacaggtgaaccgcccattaagaaataattccctttcggttttttctcaataatgctttgtgcttgtagttcacctactttttcattatcgaacgaaacatagaaatcaatatctgcgttattgatcagacggtcataagctaaaactttaaccccctcttttttggcttcagcgatcacgtttgacaatacttcgccattgaatggaataatcactagcacatcaatatctttatttagcatattctcaatttgagaaatttgagctgtcgcatcaccatttgcagattgaacgaatacttttgcacctaaagcttctgcttttttcacaaaaatatctcggtctttttgccatctttctaaacgtaaatcatcaattgacatgccgattttcagatcgtttgctagcactgaatggctaaaaaccattaaaattgctgtcgcgaccgctaataacttagatttaagtttcataaaatacctcacttggttgagagaatgatgtaagggtataatgtagttgccccgagtgaagtctgcggagatttggtaataagtgcaattatcagatttattaatgtaattatgttttttcgcttttgtgatctgttcgacattaaccaataatctaaatccaaaaacgaaatatcgtaattgagggttgttttcaattttaagatgatgagccttgtattcatatttatcacatctcagaggagacttggctatgtctaattattttgacaaaattgcaaaggtaaattacgaaggagcaaattccactaatcctttcgcttttaaacactacaatccaaatgaagttattttaggtaaaacagtagaggaacacttgcgtctggcagtctgctattggcacacgttctgctggacaggtaacgatatgttcggtgccggttcattggatcgtagttggcaaaaaacaggtgatttgctggttggtgcaaaacaaaaagcagaaattgcttttgaatttttccaaaaattaggtgtgccttattatagttttcacgatgtagatattgctcctgaaagcaataatttcaaagaatatttacataacttcaatactattgtggatattttagagaaaaaacaatcagaaaccggtgtgaagttgttatggggaacagcaaactgctttactaatcctcgttatatgtcaggggcttctaccaaccctaatccggaagtatttgcttgggcagcagcacaagtttttactgcaatgaatgcaactcaacgcttagggggtgaaaactatgtattatggggcggacgagaagggtatgaaacattgctgaataccgatctcaaacgtgaacgtgaacaaattggccgttttatgcaattagtggtagaacataaatataaaatcggctttcaaggtacattactaattgaaccgaaaccacaagagccaactaaacatcagtacgattatgatgttgcaacagtttatggttttttaaaacaattcggattagaaaatgaaattaaagtgaatattgaagctaaccatgcaaccttggcagggcatacattccaacatgaaattgcaacggcaacttcattaggcattttcggttctattgatgctaaccgtggcgatccgcaattaggctgggataccgaccaattcccgaacagcgtggaagaaaatacgttggcaatgtatgaaatcttaaaagcgggtggtttcaccacaggcggtttcaactttgatgcgaaaattcgtcgccaaagtaccgacccgtatgatttatttcatgcccatatcggtgcaatggatgtgttagctttgtcgctcaaacgtgctgcaaaaatgattgaagaccaaacgttgcaaaaagtggtcgataaccgctatgctggttgggatcaagagctgggtcagaaaattctaagtggcaaagcgagcttggaggatcttgctaaaatagtagaaactcaagggttagatccaaaacctgtttcagggcagcaagaatatttagaaaatttagtgaatagctatctttatcgttaattctgacaagcggtctttttttgcaaaattttgcataaaatgaccgctctttagattaaggagtatttatgtacattggaattgatcttggtacttctggggttaaagttgttttacttgatgaaaatcaaaaaattattgccattactcaaaaatctcttcctatttctcgccctcaacccttatggtctgaacaaaatccacaagattggtggaatgccactcacgaagcaatgcttgaattagctgataagcaaaatttaagccatgtaaaagctattggattaactgggcaaatgcacggtgctacattactggataaggcagataatatactttctccggcaattttatggaacgatggacggagctttgctgaatgcgaagagttggaaaaattagtgtcaaatagtcgtgaaattacaggtaatgtaatgatgccaggctttactgcacctaaattatgttggcttaaaaaacatcagcccgatattgccaaaaaagttagtaaggttttgttaccaaaagattatttacgatttttaatgacgggagaatacgcttctgatatgtctgatgcctcaggcacaatgtggctggacataggtaaacggagttggaatgaagcacttttgaatgcttgtggacttgatttgaataatatgccgaaattatttgaaggtaatcaaatcacgggttatttacgcaaagaaattgcacaacaatggaaaataaatgccgtacctgttgtggcaggtggcggtgataatgcagccggtgccattggtataggactttaccaagcagagcaagcaatgttgtctcttggtacttcgggtgtgtactttgtggtaagtgatacattccgtgccaatccacaaaaagcagttcatagtttttgccacgcactgcccgatcgctggcacttaatgtcggtgatgttaagtgcagcctcggctgttgattgggctgcaaaatccctaggctttaaagatgtaccaaccttatttcaacgagttgaagcaagccaaaccgagtccaatgtcattttcctgccttatttatcaggcgaacgtacaccgcataatgatccttatgcgaaaggtgtattttggggattaagccatagcgataatcaagttacgatggcaaaagccgtcatcgaaggcgtgagttttgctatggcagagagtattgatgttttacatgaaacaggtgttactgcaaataatattgctcttattggtggtggagcaaaaagtggttattggcgacaattacttgctgatattagcggtaaaacatttgaatatcgtacaggtggagatgttggcccggcgttaggtgcggctaaattagcacaaattgcattaaatccagaacaagatattgcgaatttctgccgaccgttaccattggaaaaaatctatcagcccaattctgctcgctatgcagaatatcaagctaaacgtgagaaattcgcagagctttatcaacgagtaaaaggtctatcattgttttctttgtaaatcaaagatatataaggcttttcttgatctaaaagtgcggtgagaataccgcacttttaggggtatattttggatacaaaaaaccggcgataacaacactgctatcgctggtttagttttatatgatgaattagttaaacacgccgctgatgccgacacggaaaccaactcggcctctactatcagaagaaatgccgccggatatggcatattttccgtttgcggaagttctaccgaggtttaaagagaccgcactttcgctgctataatgagcggcaccggcggcataagaccattttcccgggacgaaagggacttctttgaaagccatagcggcggcgataccggctttagcgtctttgttgacttcttcaagacgttggttagtggcatgaagctgactaccattgactgcatcagtggattgatgagaaagcaaacctgcggcaacattttgaatacggcgttcattgcctttgctgcccacggaaacgacgcctttagcgtcagcaccggcataattgccgtcaactttaccgataccgcctgaagtttcgctttggtcggtatatctggaaccatcgcctagaaacacagaattatcagtggtaacatcaatattattacctatggcaactgttttggtgccgttattcttaatattacgacccattgagaaagaattatctttggttgtatgtacaccactaccaaaacttagtgaaccttcgcctgagactgttgcttgcggaccgatggcttgcgatcgtttaccactagcagttgcttgccaaccaagtgcggtagaggcttctcccttcgcattagcagcccaaccaaatgcagtactatattcaccctctgctttagctcttgcaccaaatgccgaagataatttgcttgctactgcttcatcacctactgctactgcaaaatttccagttgctttagaatctttacctatagaaattgcctgcgtacctgcatttgcttggaagcccattgctacggcataagattgtgcctttgctgtcttaccaaccgcagttgctccttcatgtgcagcatttgcatcaaagcctacagcgacaccggactcagctactttggcattttttccaacggcaacggatttggtaccattcttataatttccttctgccttagtaccttcaccaatataaacatgcccattactaacatcaatattactactatttgattgttgagcttgagccatagccgaatgagcagttaaaacaactacagcagttaaagataaataaaaaattttcacttaaaagaaatccttaaaaaaagagttaacatagaaaaatcataaaaaagctaaccgcactaagaggcgataatttatgacacgccttaaaaagaggtagggggacctaccaaagcgggtgaaattttaagcggggggggggtactgtcaatatatttttttacaaaatgtttacttttttaacaaaattgaaacggtaaaaaacatttgtcgaacacggaaaaatattcatttgtttttgtgttatggaatgcagtagaaagaagaaatgaacttgcgtaagtgatttaaacgctccacgcattttcatctagtacttgtccaaaatgactttcaacgaggcgtttggttatatcgctttgtggttgggtaaagattgtttttgtatcgccatattcgatcatttgtccttcgtccatcactaatacatgatcggctatgtgtttgatgatgcctaaatgttgacctacataaatataagagatgctgagtttctcttgaatgtctaacatcaaatttattaattgagttttgactgtcgcatcaagtgagccgagagcatcatcggtaataataatttccggtccaagaataagtgcacgcgcaatagcaacacgttgtttttgaccgatggacatggtattaatttttacattggcatgttcgggataaagtcccactaaacgtaatgtttcagctattttaagattacgttcattttcgtttaggttggttgtcaggcgtagaggtgcatctaaaatttgtcctacatttaaacgaggattaaaggcagaataggggtcttgaaagaccatacgaatatgttgtgaacgatattgataatctccgtactctaagggatttcctttaaatagaagttcaccagatgtgggttttataataccaacgatcattttggcaacagttgattttccggagccatttttaccgataatagccaatgtttttttttgtgccaaaacgaaactaatattttctacagctttaaattggcttgtgctgaagataccaatattatcattaaaaaattttgataaacctgaaacttccagtaagttcatttttacttcccgttcttattttgttgtgtttacgactaatgggccagtttccatttctttttctctacgttgactttcttttaaattaatagggaaatggcagaaaaattcatgttgtttaatccgttgtgcacttggttttcgaatacattctttttgtgcaaaaggacaacgtggacctaaacggcaaccgataggcattccttctaataatggaacagcaccttttagcgtactcaaacgacttttatgtactaagggctgtttaaaatcaggaatagaatgtaataatgctcttgtatagggatggtgaggattttctaaaatgttttctttagatcctgattcagcgttttgtccgcaataaagaactgaaaaactatcacaccatgcactaatactatttatatcattacttaccagcagaatacttgttccctgattttgattcatactggcaagtaaacgaaatatttgtacttttgtcattgactcaagagaatttgtaggttcatcagcgattaataatcgaggttggtttgcaattgcaagggcaatcataattttttgcccttcaccttcagttacttcatgtgggtaactttgcataatatctttatgatctttcacacctacacgatgtaataattcaatagcacgacgttttttccaaccgaaccattgccaccatcgccctttaaatgtccaagagggaatgctctgaataagttgttgtccaatttttcggctaggatctaaagatgctaaaggctcttggtaaatcatggagatttctttacctaccagtttacgtctttttttgggatttagttttagtagttctacatcgtcaaaacgaaaacgatcggctgtaataatccaagaatccttaattgcattacaaataactttagcaatcaggctttttccggaacctgattcaccgactaaaccacagatttcaccttcatttaaggttaaattaacattatcaataattttgactcgtccttttggtgtttctatttcaatacaaagattacgaatatcaagtaaagccatgtcggttgtccttatccataatatttttctatggctttacaaagcccattagtcaaaatgagaacgataacaatggtgatgataatagcaacaccgggtaagattgttgcccaaggggcaagataaattaattctatataatcttttatcattgttccccattctggcgttggtcgttgtgcacccaacgaaataaaacttaatgcactaatatcaataatggcaatgataaatgctctgctggtttcatgaatataacgaataataatattaggtaaaatggtttcttttacaagttgccaattacttgcaccatcaagtcgtagcatcaaaatgtattcttttttcagttcttgttgtacggcttggtaaatttcatgaataaaatagggaagtaatgcaagcgtgatggcaagcattgcattgattaagcttggttgcattaatgtagcgataataatagcgatgagtaaaatagggattgataagaaaatatcaaaaaaatgtcctaagactcttgcttttaacccttgtgataatcctgcccaaataccaagaattccacccaaaatagatgtgaataatacaacaatgagggcggcaccaaaagtgtaagttgtacctcgaatcaaacgactaaaaatatctcgtccaatatcatcagttccgaaaaaataggcaatttttccgttatcagcccaagagggaggtagtaactcaaaaccaataaactgtgctgtatcactataaggtgcgataaattgactgaaaagtgcggtaataatgagtaataaaaaaagataaaagccagttaatgccaatttatcttggtagaaaaatttccaaatatgttttaatccttgtgtttcgcgaaattcttcaggttctttatctagcataccagttcttcttattaaatgggtccaaaataaaggataagaattcagtaaataaattcactgcaataatacaaaatccaacaacaataatgcctattgaaatgctattataatcttgttgtctaactgcatctattaaccaatgacctataccgaaccaaccgaacgtgctttcaatcagcatacattgagccataacaagagtaaataaacgactcatttgcgggatcatgataggtattgtgttacgtaaaatgtagatttgtagaatttttctttttgaccaccctcttgtttctgcaattttgacataactttgggtgaataaaaaatcagctcgttgctgaacgattctaataatatccatagttggcagaattgcgagaactaatgtgggcaacacaaggtgttgcaaaacattttgaatcattttaatacgataaggctgatccgtaaaccaaacatcaataataggaaagcctgtaatgggctttatctcatacaataaattatactgtccaattgctgaaatttcccaattttgaatagctgaaaagtacaacaagattggtgctaaccaaaaaacagggatagcaatacctgtgatatagaaagaacgaatagctttgccacacaaatgatctgcatataatgcactgagtaatccaagaggaataccgaaaattaatgctaacagcattgcactaacacatagctctaatgtaggaggaagtacagcaaaaatcaattcttttagtgattctccgccgtggtaagtaataccaaaatccccttgtagtaaattttgtagatagaaaaaataccctgaaaaaaagtgcggtgttgctagcacttgatttaatggatctttgagcaggatgctgtaactgatgagagataaaataaacagcgtgctgatgactaaaatgcagtgacgaaaaaaggaaaatagcattgttttattacctgtttataatttctattattttttaaatgacagttttgaaaaattaatattgccaaacggcgttaattcaattccttgtacttttgcattcgctaacagaacacgttttacgttagcaataggaagaatagggatttcggataaaataatttcttgtgcgatattataatattttgcacgttcacgtaagttcgatgcggctaatgcttgatctaaggcgtgttcaaaaggtgcatggcaccaatttgaaaaattagttatttcgttttgtgtaccgcaacttaaaatgggacgcataaaactatcagggtctagatttcctgctaaccagccagttaagataatatcgtaatcctcagtttgttcttgaagctgtttcattaaataagtgcgggtaacgttacgtatatttacattcaccccaaccttaattaaatctgctttaattaattcagccatttttattggcgaagggttatacacttgttcttcattaataacccacatatctagatttatattttttcctgcaaagtattcctttgcttttttgacattatagtcataggcaaaatcagttgtatttacagctgccccccaagatattgatggaataatattgttcgcaacacttgctgtattatgataaatcaggttaataatacgttggcggttaattgcatgagcaatatggcgacgaatctccagatcttgcataagtgttttttgaaagttaaatgcgatataagataaattcatgccttcaattgattttatataatatttttcatcattgtgacgcaataaccctaattggctcagttccggataagaggcgatatggcattcattattgaagaatttaattaatctgcctgagcgattggtggaaagatcaatgatcacgttttccaagtttacatttttttgccaataattagggttatgaacaagacgaacatattgattacgaaagtaatctttaacctgataaggaccggtgccgacaggtaaattatctaattgcactaaattgtcgtccgcattgagttgcaatgcgtattcttgagaaaaaataatggcgtattggctggctaggtgggaaagcacggaagcatcgggtttaaacaagataatttgaacttggtaaggattgattgctttcacttcctgaattttttcatttaatttaatgctgtcaaaataaggaaaatgcacttttttacgttgttcgtgatagaccttatattgtggatttttatagtgaagagtgttttgatctaattccggtagtgctatattttgaccgagtatgcgatttaatgaaaaaaccacatcttccgcattaaaatcacggcttggtgtaaaccagtctgtatgatgaaatttaacgcctttgcgtaaattaattgtaataattttcccatcaggtgagatactataggattttgccaaaactggttcaagagttgcactatgatttttaatttcaaataatttattgtaaatttgctccgtgactatattcatactggttccggcatctgcagtttgaggattaaaggaaaaactgcttgcattggtacaataaatcaaaccgttgtcagtgagtattttgggtatttttggggcactaaaagagggcaaactaaagagtagcccatagaagagtgtacataatataaaaatcttttttgccaacataacttaattaattatgataaattatatgggaattgtaaggcatattaacgcaatatagaaataaaaatgtttaattttatccataaagaacttgatgaactcattaatcgtggaatggaccgcactttacgcattgctgttacagggctgagtcgtagcggtaaaactgcttttattacaagttttattaatcagctattacatattaattccattgacaataaacatcttccgctatttttacctgcacaaaataaccgtcttcttggtgtaaaacgtgttgaacaacgagatctcagtgttcctcgttttgactatgaacaaaatatgaaagcgttgaagcgtgagcctgcaagttggtttaaatcaacggagagtgtcagtgaaacacgtttagccattcgttatatacgtaaagatggcttaatgcgacatttaaaagaaaaaggcacattatatgtagaaatttttgattatccgggtgaatggttactggatctacccttactggatttggattttcaacaatggtctttacagcaacaagagttatttattgagcaacgacaagaattagcacaaaactggctgaataagatccgcactttagatttaagtgagccggcaaatgaagaaatgttggcacaacttgcccaagactatactgaattcttatttgcttgtaaaaaacagggatttcatttaacacaaccgggacgctttgtgctacccggtgaattaaaaggcgctccggtattacaattttttcctctggttcatttaactgagcaagaatggaaaagactaaaagagcggtctaaatctgatagttattttgcgatgttgagcaagcgttatcatcattatcaacaaaaaatagtgaaaggtttttatcaagaatatttttctacttttgatcgtcaggtgattttagcggattgcttaacaccacttaattatggtcgccaagcgtttcaggatatgcaaaatgctttacagcaactattcaaaaatttccattatggcaagcgaactttattcaatcgtttgttttcgccaaaaattgataaattaatgtttattgcgaccaaagcggatcacattacattggagcaatttccgaatttagtgagtttaatgcgtcaattagtacaagagggagggcgttacgtagaatatgaaggaatagatactgaatatactgcaatttccgccattcgttctactcaacaagtacaagtaacgcaaaatggacaaaagatcaaagcattacaaggaattagatcaatagataagaaaaaaattgttgtatatcctggaagtgtaccgagtaaattgcctcatgcagacttttggcagaagtatcattttgcgtttgatcaattcgaacctcttacagtggaaaatggtgagccaatcgcccatttacgtatggatgctgtcttacaatttttattagcagacaagttagattaggatataaatatgccaaaaaaggtttttcaacaagaagatgttgagcaaaaaatcacagaaaattttgagcctaaacaagaatttgagcaagacgaattagatatagaaatggactgctctcaatttgaaacaacaatggatcggcaaaatacagatattccttttcagcatatggttagaccaaaagtgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggaacaataataaaagaatggcgacgtttagttcaactaaaaaagcgtttgatattacaagaaaaaagccgagaaattcgctcaaaaagtgcggttaatttaactgaggtttcttctgagggcaaagagttgtgtttaaaaattgcctcgcttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagctattgtggatatgttctttatcgcttggcgtaatattcgtttgattaatcaattagcaaaactttatggtattgagttgggctatgttagtcgtctccgtttgttacgcatggtttttgttaatatggcatttgccggtgcggcagaagtcattcaagatctcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtagaaataatttattagtttcaaaaagcaaagattatatacataaaatctgcactttaataagtctgttaaactgttagagtgcagattaaaatgaccaatttttactcttaagcgacaacattaaattgtgctttcatcaatgcttcgaaatctgtgcaaccgccaataggtttttcatcaatgaaaatttgcggcacagtttctaccggtttaccgacagacaatgatagatccgctttactaataccttcagcaacaatatcaatataacgataatcgaagtcttcaagggtattttttaatttttccgctaagttttttgcacgaacacaatacgggcaacctgaacgaccaaaaataacaacgtacatatttattttcctttttgtcttgttaataaaagaacaaccacattgtaactcatttggggcaaaaattttagcattgttacaacgaaaaaagcctatttctatcaatatcagaaattattcctaactatcaataagttcaatagtcacaccgttatgtaatcctctcggcagaggcgatcctttgcgtcctcgctcagcacgaaattttcgtatatcctccggttttaaggtgacttttcgttttccagcatgaaagacaagactggttttttcgctgatcaagaataatttgaccaataattctgaccgctctttagcatttgcagcgggaatatgaatgattttgttgcctttacctttggataattcaggtaagtcggcaacaggaaaaaccagcattctattcatggaagttaaagcgaccaaaagtgcggtagaattttgcaaaactaatggaggtagtacgttggcattttccggtagggaaataaccgcttttcctgccttattgcgagataccaaatcttcaaatttacaaataaatccatatcctgcatcagatgccataagcaaagattgattttcgttttctatcagtaaatgttcaatagtagcaccgctaggtaaggtcaattttcctgtaagcggttctccctgtgatcgggcagaaggtaaggaaagcggatctaaagtgtagctacgtcctgtgctatcaataaagaccaccggctgattgcttttaccgcaggcatgggtcaaatagttatcaccggtcttgtagctcaaagctcgtgcattaatatcatgtccctttgcacaacgtacccaacccatttccgataagataattgtaatcggttcgctcggtgtcatatctgtttcagaaattgcttttgcctcagcacgttctactaaaggcgataggcgagggcttgcgaaagttttcgcatcttgctgaatttcttttttaattaaattatttaagcgaatttcagagtttaatatttgctctaaactgttccgttcttttgctaaattatttttttcagcttgcaattcttgttcttctaatttggctaaatggcgtaagcgtaaatttaaaatcgcttctgcttgttcatctgttaaattaaagcgtgcgatcaatatttctttaggcttatcctcattacggataatttcaataatctcatcaatatttaaaaaagcgatgagtaggccgtctaaaatatgtaaacgagctaacactttatctaaacggtattgtaagcgacgagtcaccgtttgacgacggaaggttagccattccgttagaatttgaacaagattttttaccgcgggtttattgtccaagccaatcatgttcatattaacacgataacttttttctaaatcagttgtggcaaataaatgagccataagtgcatctgtatccactcgatttgaacgaggaacgatgaccaatctaattggattttcatgatccgcttcatcacgaatatcttctaccattggcagttttttattctgcatctgctcggcaatttgtgccacaatttttgacggagaagattgatgaggaagtgcggtaataattatttcaccattttcttttttccagacggctcgcattttaattgagccacgtccctgttcgtaaattttacgaatttcttctttcggtgaaataatttccgcttcagttggaaaatcaggaccttgtagtgcggtcatcaattgatctaaatctgcattaggattatctaatagcataattgtggcatcggcaacttcattaagattgtgcggtggaatatccgttgccatacctacagcgattccagttgtgccgttgagtaaaatatgaggtaagcgtgcaggtaaatattgtggttcttccaatgtgccatcaaagttggcttgataattgactgtgccttgtcctaactcggataataaaatttccgaaatttttgacaagcgagattcggtataacgcatggcagcgaaagatttgggatcatccggtgctccccagttaccttgaccgtccacgagaggatagcgataagaaaaaggttgtgccatcagtaccattgcttcataacaagcactatcgccatgcgggtgaaatttacccaacacatcaccaacagtacgtgcagattttttatattttgcactcgcattgagtcccaactcagacattgcataaataatacggcgttgaacaggttttagcccatcaccaataaaaggtaaggctcgatccatgatgacatacatggagtaatttaaataggctttttccgtaaactggcggagtggcatttgttcaatgccttcgtagttgattgtgttcatatggttgtttttcgtttacttaatgaaaataaaaatgtatttaaactatgattttaaaatcatatcgtcaatattatcctgaaagacaaatttacgatgataatcaaggtatttttctcttccttcaggataaattcgcattttatttttcgcatttgggttgatatgcaatttctcccaagtataaatgcttagttgtgtaccgcagattagctcgccattatccgtaaatgtgatatatccctgatcaaataaccaatcgtatgttggagtaagagataaaccattcaaatgatccaatgcctcattttcttttccttccgagatacaaacactgtaaggtttgatatggcttgcttttaataacacatcatctttaattaaagtaaatgggcattgtggcatataatctaacacttttctgcgatattctgactgtccttttcgccctgtccgtttaactgcacctttcttttcatcaattaatttttctgtcatttgcgatgatgattcagtaagttttggatgaacaatggatctaaattgataatctaaaaatactctgaaataaaacaaaggtttttgctcttttccttgaattttctctagaagcagtttcaaaatagataaatagctaattttaggaagaattaatgctcgccatatattccaaatatcggcatctgaacgaatataacctctacgacgtgtaggattaccagtgactaaatcagacacatcataaattgaaaattcatttatctcattttttaaatcaataatagaatttaagtaatcattataatattcggaaatatctgtgtgataatgttgttcttgtttgtgaaattcaactctagcatcatagagatatttcaataggttgcttttactaaaaaaacaattttcttgaatagttggatattctgctctcttattgttaacttgtttagctgccccccattcatgatactcaaaaaaatcacttaatctagcaccgctattgccaacataactaccgacatattttcgtgcttcaccattccctgtaaaaatggataatttgtttttacgatgaataaaactatcttccgcacgtaaattttgaatagcatcaatgataatgtaattttcgccattaacatggattttttgaaatttttgcatattcctattctccgtattgtgtaatatccatttgttttagcaatgcgattaacacatcaacgacaatactatttcctgcttgtctgtatgtttgagtgtcgctgacgacaatttggaaatcatctctaaatcccattaaacgtaaacactctcttggcgtgagctttcttattcttccttgattatgagtaacataattatcgacgccggcacggtgcattttgtgcattgtttgtaataaaggacgagctactgataaatcagtttgtgtactcgttttgaaattctttgttccacctgctaaaacataatcacgaattttgctggataaataatatttttcttcgacatcattaatgttaaaaataaactcatcaaaactgcttttatttattttgggcacaaaaacaaaatcaccatgccaattaaattgttggttggctttttgacataacattatatcgccattaatttgcgtatagcgtttttgccgatttttagaactggttacaaatttaatgcctttttctttaagaaaatatttgctatcagtgtaatcctctagaaaatcttgcatcgtacgctctaaaggaatcttagttggaaattggaatccgccttttggcgaggttttaaatcctacaacaaaaatacgttcacgatgttgcggaataccataatttttgctgttcattacttgaaaatataaatcgtagcctaagctatgaaaaacatcttttactacttgccaagtatttccaccatcgtgatttaataacccttttacgttttcataaataaagacttttggttgagtctcatttaccactctcgcaaaatcataaaaaagcgtacctcgagtatcttccaatccatgtcgttttcccaccatagagaaagcctgacaagggcttccacccactaaaatatctacttgatcacggtaaggtatcgcatcaaaagtggtaatatcagaatgccaatgttcttcagataaatcgtaattggctaaataactttttttaacgtggggatcaatatcgccagcaaaaacaatacagtgatttagttctaaacgtttgaaagcttgttctattgcaccaataccactaaacgtcgtggctaagcgtatttttgcattaggatttttaaatgttttaaaacgccaatcacactcatcaaataagggtaattcaaaatttaggtttgttttatccacgagatttgtcatataaatataaaataaattttctatttttagagagtacttaaccaaataattcacacagcaaaatccacttgatcaccgttattttgcaaccaaattttccgatcttcggaacgttttttagctaataacatatccatcaattctaacgtagatacatcttcttcgtggggttcgtaggttaattgcaccaaacggcgagtgtttggatccattgtagtttcacgtagctgattaggattcatttcacctagccctttgaaacgctgaacattgagtttgcctctcttattttttaagcgtgctaaaatgctctctttttcattttcatcaagagcataaaaaacttcattacctaaatctatacgataaagtggaggcattgcgacataaacatggccatgttgaactaattttggaaaatgacgtaaaaataaagcacaaagtaatgtggcaatatgtaatccgtcagagtcggcatcggctaatatacaaactttaccatagcgtaattgagataaatcttcgttgtcaggatcaattcccagtgcaatagcaatatcatgaacttcttgtgagcgtaacacttgatctggtgaaacttcccatgtgtttaaaatttttccccgtaatgggagaattgcttgatgttcacggttgcgagcttgtttggctgagccaccggcagaatctccttctactaaaaaaagctccgttttacttaaatcttgttcactacaatccgctaattttccgggtaaagcaggaccactgactaattttttacgcacaactttttttgctgcacgtaaacgtctttccgctgaacttatcaccatttttgcaagttcttcggcatcttgaatattttgatttagccataaactgaaactatcttttacaacgccgccaacaaagaccgcactttgacgagaggaaagtcgttctttagtttgacctgcaaattgtgcatcgtgcatttttactgataacacataagcacagcgatcccaaatatcgtcagcggttaatttgacatttttgggtaataggttacgaaactcacaaaattcacgcatagcatcaagcaagccttgacgtaagccattgacatgagtacctccctgaatggttggaataaggttgacataactttcgttaagtaattcgcctccctcaggtaaccataataatgcccaacttgccgcttctttattcgtactaaaattaccgacaaaagggttttgtggtaagagattatagccattaacattttccattaaataatcagataaaccgtcttggtataaccaagtatcctcagtgttattgattttatcgataaatttaatttctaatcctgaacataaaactgctttagcacgcaataaatgacgtaggcgactgactgaaaaattagcactatcaaaatatttcggattaggtttgaagtgaacggaggtcccggttgtacgctttccgcaagtgccgataatctctaattcttctaccttaacaccgttttcgaaggcaattttatagatttcaccgttacgttttacctgaatatctacacgctcagataaggcatttactacagaaatacccacaccatgcaaaccacctgcaaattcatagtgcttattggaaaattttccgccagcgtgaagtttagttaaaataacttcaacaccggatactttttctgttgggtgaatatcgacaggcattccacgcccattatcaatcacctctagagattggtctttatacaaaataacttcaattttggttgcgtgccctgcaagtgcttcatcaacactattatcaataacttcttgccctaaatgattagggcgagacgtatccgtgtacataccggggcgaagttgaacgggttcaagatcttttaaaacggttatttcttgtgctgaataatttgtcataatgccatgtgatcagtaaaaatttggagaattttaacaaaaaaagtgtcacctttcatcttgattgttgtgtatcttcttttgaattccaaggagcaacccagaataggcaaagcataccgggaatggctaaccagaaacaaaaccagaaatagtcatagtatcccaagtagttgattaaaacgcctgcttgtgtattgaaggtaactcgaggtaaggcggcaaagctggtaaataaagccagttgagtggcggtataaagcggattggtttctcgtgccataaaggcgacaaaggcagacgtacctaagccaataccaatatattcagcggcaacgactaaactgagagaaatcagagcaaagttatctatttcctgaaatggacctaattttgccaaccatgcaaagcctaaaattgttacaatttgtacaacaccaaaaagccataatgcacgattaattccgattttcagcatgatgacaccaccaataatactggcgatgagcatcggccacaaggaagaatttttgaccactatgccaatttgggtcatgttataacccatatcgagataaaacggcgaaatgagggctgttgccatactatcgccaattttatagagaaaaataaaagcgagaataccaagtgcggaagacgtgcctttgcgtgtaaaaaattctttgaacggttcgatcacattttcttttaaagtgcggtcattttttagctgaatttgaggttctttacttaaaaataaggtcataaaaataccaggaagcatgaagagtgcggtaattaaaaagaccgttttccaaggtaaatagtctgccagaattaaagaaagtgagccgggaacaagccctgcaatacgataggcatttacatgaatagaattacccaagcccaattcacgatcagagagaatttctcggcgataagcatcaagtacaatatcctgacttgccgaaaagaaagacaccagcactgcaatacctgcaatcagttgtaaattaaaggaggagcttggttgtaaaaaaccgaagaaagcgagtgaaatgagcagtaaaacttgcgaaatgagtaaccaacctcgacgccgtcctaaaaagggcggtataaatcggtcaagcaaaggagaccatagaaatttccaagtaaaaggaagcgttgtagctgtaaaataacctaaggtttccaaatctacgtgttctttacgtagccaaagtggcaataaggaaatgataatataaaaaggtaatcctgagctaaagcctgtaaacacacaaataagcatattacgactaaagatttgttgtagcattgagtgagatttttccataatttttccgtatgtataaattttttcaacagtatagatgattttttcacgttcatgataggatttttttattcacataacaagtagataaaatcttttacgcaaacgtttactatttgaaagtttcaggtaaaatacgcgaactttttttattcattttaatttgcctataggggacgctatgtctttagaaaaaacttttgagttgacgaaacgtggttctaacgtacgtcaagaaattattgccggattaacaaccttcttggctatggtttattcagtaattgttgtaccgaatatgctgagtgcagcgggatttccggcagaaagtgtgtttatagcaacttgtttggtagcaggattaggttcaattttaattggcttatgggcaaatgcaccgatggcgattggttgtgctatttcattaaccgcctttactgcatttagcttagtgttgggacaaggtgtgagtattcctgtcgcattaggtgcggtatttcttatggggatagtctttactttaatttctgcaacaggtattcgctcttggattttacgtaatcttccgtcgagtattgcacatggtgcaggtattggtatcggtttatttttgctacttatcgctacaacgaatgtgggtattattgtagccaatcaaaatggcttattagttaagtttggtgattttacgtctttctctgtgctgatgtctttggttggacttgctgtaattattggcttggaaaaaatgcaagtcaaaggtgggatcttatgggttatgatcgcaattacgatcgcagggcttatttgggatcaaaatgtacagtttaaaggcgaaattttcagattaccgacttttggtgaacaatccttatttttagaattggatattatgggagcattacaaccggcaattttacctattgtttttgccttagtaatgaccgcagtatttgatgcaacagggacaattcgtgcagttgcaggtcaagcaaatttattagacaaagatggtcaaattatcaatggcggtaaagcattaacagcggattccgtaagtagcttattatctggggcacttggtaccgcacctgccgctgtatatattgaatctgccgccggaactgctgctgggggtaaaacaggtatgacagcgattgttgtcggtatactgtttttattaatgctatttttccagccattagcaagtttggtgccaaactatgcaactgcacctgcgttaatgtacgtaggattattaatgttaagcaatgtcagcaaacttgattttagcgattttgttggtgccatgagcggactggtttgtggcgtatttattgtactaactgcaaatattgtaaccggaattatgctaggttttgcaactttagttatcggtcgtttagtttgtggtgattggaaaaaacttaatgtaggtacagtcatcattgccattgttttggttgctttttatattggcggttgggcaatttaattgtatataaaatgttaggtgggtaagcttagtcagctctcgaaagtatctacaaaaaaccggcgataacaacactgctatcgctggtttagttttatataataaattagttaaacacgccgctgacgccgacacggaaaccaactcggcctctactatcagaagaaatgccgccggatatggcatattttccgtttgcggaagttctaccgaggtttaaagagaccgcactttcgctgctataacgagcggcaccggcggcataagaccatttacccgggacgaaaggcacatctttaaaagccatcgcggcggcgataccggctttagcgtctttattgacctcttcaacacgttggttagttgcgtgtaattgactaccgtttactgcgtcagttgagcgatgagaaagcaaaccggcggcaacattttgaatacggcgttcattgcctttgctgcccacggaaacgacgccttttgcatcaacgccggcgtaattgccgttgactttaccgataccgcccgttgtttcgcctttttctacataagcagaagaatcaccgaggaagacggagttattagcggtattatgaatattattacctataacaacggcgtttttagaacttgcttgtatgatgttattatgccccatggaaacagctcccatagcataattgttagtttgagatcctatcgatacaccattctcagcagttgtatttgtaccactaccaaagctcaatgcacgcttaccggatgcttttgcttcaggaccaatagcttgagcacgttcaccacttgcttgtgcactccaaccaagtgcggtagaaatttgacctgtggctttagcagctgccccaaatgcattagcccaactattagcataactatttctaccgatagcaaaagatgattctccttttgcgttagcttcattacctaatgctaccgcaaaatttccttgtgccttggatttgttacccatagaaatcgcctgtacacctgcatttgcctgaaaacccattgctacggcataagattgtgcctttgctgtcttaccaaccgcagtagccccttcttttcctgcatctgccttataacctacagcaaccgcggactcgccgacttttgagctttttccaatggcaacggctttgctttcacccttaagagaaccatttttaggatagtcagtattttcaccaatataaaccccactgttttcaatcttaatatgattattaccactatttgattgttgagcttgagccatagccgaatgagcagttaaaacaactactgcagttaaagataaataaaaaattttcacttaaaagaaatccttaaaaaaagagttaacatagaaaaatcataaaaaaacaaccgcactaagaggcgataatttatgacacgccttaaaaagaggtagggggacctaccaaagcgggcgaaattttaagcggggggggggtactgtcaatatatttttttacaaaatgtttacttttttaacaaaattgaaacggaaaaacatttgtcgaacacgaaaaaatattcatttgtttttgtgttatggaatgcagtagaaagaagaaagaaaaaatgaaatgataattggcggaacggacgggactcgaacccgcgaccccctgcgtgacaggcaggtattctaaccagctgaactaccgctccgcaataaaagaaataataaggggaaatttggcggaatggacgggactcgaacccgcgaccccctgcgtgacaggcaggtattctaaccggctgaactaccactccgcaaaagtggagtgcataataatagtgaatagatttttcgtcaagttatttttatttattatgcacttatttttgctaagtgttgattaagcaaacattaatgcatcgtttcttttgtatttcgcttaaaccataagcaattttctttgcttttttggtttagcaattttagataatcttggtgagccagtttttcttcttctgtgggtaaaagtaatttgaaattatgagtattggtagtatgttgatgaatattttcttccagcgttataatcggcgtatgttcttcatcaccaaataaactggtttgtccacctgtcatggctaaataaacatcacctaaaatttcagcatcaagtaatgccccgtgcaatgttcgtttactgttatcaatatttaatctgtcacaaagtgcatctaaactattacgctttcctggatacatttgacgagccatttgtaacgtgtcggtaattaagcaaatatccgctgtattgatattgaaattgtgttttttaaactcataatccataaaaccgatatcgaaaggtgcattgtgaataatgagctcagcccctttgataaaatcaataaattcctgtgcaatagctgaaaaatccggtttatctgccagcatttcatcagtaataccatgtactttaattgcttcaggatcaacgagacgatccggttttatgtaaagatggagttttcttcctgtgtagcgacgattgatcatttcaactgcaccgatttcaataatacaatgcccctcataatgtgcaccgaattcgttcattccggtcgtttccgtatctaggataatttggcggttttgtgtgatttctaatgtcatactattttgctgttgcttgaaatgaatttgcggtattatcaccccatttgagaaaaattagtagaaaattatgttaaaaaaaattgaaatttttaccgatggatcttgtttgggaaatcctggggctggtggaattgggattttgttgcgttataagcaacatgaaaaaaaactgtatcaaggcttttttcaaactacgaataatcgtatggagttaagagcggtgattgttgctctaaatagcctaaaagaaccctgttcagtgattttgtatagtgatagtcagtatatgaaaaatgggattacaaagtggattttcaattggaaaaaaaataattggaaaaccagttcaggtaatgcggtgaaaaatcaagatttgtggtgttcattggatcaagctattcaaaaacatcaaatagaatggcgttgggtcaaaggacataatggacatcgagaaaatgaaatttgtgatcagcttgctaaacaaggtgcggaaaacccaacgctggaagatgttggttatcaaacagaatagaacaggctaaataaaattggagaaaaagagtaggcgaaataaatgatttgactccaaaatattcgcctttatttttaaggtaattttgcaatgactgcataaccctcttttagaccttcaatttgataattaacctcggcacaaataaaagcactctctccctgttttaattcaagtgcggtgtgatttgcggttatttttaatgcaccttgcatgacgagtaaaatctctgcgttacttgaggttagggtgtgtttttgttgcatgctataacgtacgtttgtcatggcaaaatctttagcgggcgtagtgtaagtaaagatatcttgatcttgtggtgcggtaagaataatgttaggcgtaacctcactacaatcgacaatttttagcagttcctcaatatttatgtgtttcggtgttaatccgccacgaatgacattgtccgaacatgccattaactcaatattctgacctcgtaaataagcatgtgggatacctgcatcttgataaattccctcgcctgtattgagatgaacaatattaaataaatagaagcaaattaaccccgcatccagtttgtcagtcggtattttcattgcttcgattgtatataaaacccaatagtcgggattatttaatttcagttttccctgtctataagcaacctgattttcagtaataataggggatagccacgcagaaagttgagtttgatcagcttgcataattgttgcataaaaactgtgtaagtcttgattttccagctgttgggcaagtgcggttaaagatggacgagctttgaaggtttcaagaatttttgttttttgtttaaagccatgcaaaagccagaaatcagataaggcaatcatcatttcaggtttatggtttcgatctttataagttcttttcggatcttttaaatctatggctgcaagattctcttgtgcaaaacctatttccgcttgtttttttgttgggtgaagttgaattgaaagcggctttgcaacatctaaaattttcagcaaataaggcaattcatgtccaaaattcgttagggttgctttccctaaaacttgtgggttttgtagtaagaaatctgttaacagtactgatttttccgacatatttaatagagaaggggatgaggaatgagcaccaagccaccattctgcataatattggttgtgttgtttttctatgtttaacaactcgggaaggtaattttgtccaccccaaacatagtgttgtagacgaccttgtagctgataaatggtattcattttgctgtccttttatttgataatgacttataaccgccgaaaaaatgaactattttttctatatcttgtaggttttctggtgaaatcatgagatgttttttattttttaactcaataatcagagtgttattttcaagcagattaatttgccgaattttagcataatcaatataaatattttcaaagaaaaaaccctgttctttcagtaataaaacaggaaagcgaataaaggctatatatagactgagaagaatgcttatcgctaagaaatagagggttattgcgttaatttgtcctgaattttgatagagaatgatggcaatgagtacaataaaaataagtgcatctatttttgctcgctttttcaaccgcactttcaatttcgttgttcctttaagatagtccatcagaaattgatcgtaaaaggcataaagaaagaagcaacaaatacccacaataagaaaggcattaaccatatattacattcctaaaatgaaaaacttctcccgtgcagggagaagttttcggataaattaagctaagatacctgttgcggcacctaaaataccgataataaagataccggtaataatccataatgcgttaatacggttgcgtaataaccacatacaggcaaaagtgaacaataacggtaataatcccggcatcaaactatcaagaatattttgtacagttgttgtttcaatcgagccgtcttgtttttcaataacggatacgactaacggtacattaatgctggtccatttctgcactaaagcccccataatgaacaaaccaagaatcgaggcaccttccgtaagtttttgcaacaatccgccactcatatcctgaacaacatccaagccttttttatagccataagtaacaccatagtaacgtgtcgctaaacgaactaaattgaatagcacgaagaataaaataggacctaaaatacttccattgatcgctaaacctgcacccaaagcagcaaatacaggtcttgcagtaccccaataaattggatcaccgacccctgccaaaggtcccattaagcctactttgataccgttgattgctgcatcatcaatttctttaccgttcgcacgttcttcttccatcgcaatagtaacgcccaataccggtgcagcaacgaaaggttgcgtattaaagaattctaaatgacgtttaattgcatctttacgttcttgcgaatttggatccggatataaacgtttgatcacaggaaccatagaataggcaaagcctaatgactgcatacgttcgaagttccatgaaccttggaaaatgtttgaacgaagaacaacggcatttaaatcactttgggttacttttttcatttctgttgtcattttttggattcccattaatctaatctgttatctaaatcattattgttatttgctacaacttgtaccactttactttgattgtatttcgggtgaagctgaatataaagtgcggccatgattgcaccaagtacaccaagagcaacaaggttgaaatcggtaaatgctgcaataacaaaaccggcatagaagaatggcattaaatgacctgcacgcatcatattgatcaccatggcataaccgacaaccgcaataataccaccggcaatttttagaccgtttgttacgactgctggaatagcatttaacatatcttgtacaacatcggttccggctgtcaacgcaacgacaagtgcagggattgcaatacgcattgcttgtaataatagtgcactacgatgaatccaatctaagcgggttaagttaccgtcttcaattgatttatcagcagcatgttggaagccgacagttaacgcacgaacaacataggttaatacttgacctgctgcggctaacggaatagcaattgcgataccggtgctaatatcttgtccaccgacaataactaagattgttgaaacaacggaggctaaagcggcatccggtgcaagagccgcaccgatattcatccaacctaacgccaagagttcaagtgaaccgcccacgataatcccagtttttatatcacctaagactaaaccgattaatgtacaagcgattagtgggcgatgtgtttgaaattcatcaagaattgatcccataccagagatacaggcaacaataaagacaagtacgacttgtaaagttgaaatttccatttatgtcttccttaaattaaattattttttttgagtaaatccatcatatattgacgactgtcgttagatactttacgaacatctaattcaatgcccatcgcatcaatggctttgaatgcggcaatatctttatcatcaacagccaccgcactcgtaatcatttttttaccgtctttatatgccataccaccgacattaattgatttcatatcaacaccggcttctaacaatcttaaaacatcggtaggatcagtgaataatagcatcatacgttcatttgcatattcaggattgttatatacacggatcattttttctatattcacaacatgtgcggtaactcctggaggtgcaacgcttttcagcatggttgagcgaacttgatctttggcaacatcatcattgactacaacaatacgtgttactcgactttcttttgtccagcgagtggcgacttgtccatggattaaacggtcatcaatgcgagctaaacctacaatgagattgccttcttgttgtttgactgcgatttgaggttgttcagggactggttgtgaaagtgcggtagtttcagccgatttttcttcatatttcaaagcacgaacaccagcacggccggtttctaacgcaatgctcactaattcttgtaagctagggttatcgtcacgtgccataaaagtttccactaacataggcacatttacaccggttacaatatccatattagtgttatcaccaattacacgatttgccgcattaaacggactgccgccccaagtatccactaaaaacaggacttcatcgcaatgtgctaatgttgtacttaatttttcttgatacttcgtcataatcgtttcagcgttttcgcctgaaacaaaatcaatagttgcaacattctcttgctcaccaatcaacatttctgttgttttaagcaattgttcagccgcaacaccatgcgttgctatgataatcgcaatggacattcggactccttcctaaaagtattaaattgatttaaagggcgggtattctaaaggaagttttattttaataatgtgatacagatcacattttaagatgttttttgggtttaaagtgtgatgtaaatcacgctgattgcaaaaaaaagtcaaataaatgtgatttagttcactctttactcgacttattcaaaaatgcacaaacaatcaatttaacgtactttagcaagattgtttttttgagtttttaataattcagcatgtgctttcttttgctcttttattttattgttaatttctctacgctgtttagacagttccgcattacgaattgtataatcgtcaacccgagtttcgtaatcatcacgcatactttcaataatcgcacgcacatcagcaatgctcatatcattacggatatattgattcagattatccaatagcaacacacgcttttgattatcacgaattttacgattattgtcgtctatgtcgcgtaaaagtttgttttttaaccgatacatacgtacatactctaaaacttcttggaaagattgtttattgatattttccatttttttcttctcttttattaaatgaaacttcggctaatttaactttttttcccttattcgtcaaagtgttctctaggaattttcttgagctataaaaaattcagaaatttattaaaagttagttgattaagctgtgacgagatgatagaaattaaaaattctttttataaaaccaattaggataaaaatatgatgcaagtatttaattttagtgcaggacctgcaatgatgccaaaagttgttttggaacaggcacaacaagaattgttgaattggctggatcagggtacttctgtgatggaagtcagccatcgtggtaaatattttatggaaatgattacacaagctgaaaaagattttcgtcaattgtataacattccggaaaattacaaagttttatttttacaaggtggggcaagagggcaatttgctgctattcctatgaatttagccaataaaaaaggtaaaacactttatcttaccagcggacattggtcggcaactgcggctaaagaggctcgtttgtttacagaggttgatgaaattaatattttacttgatgggaaattagaagtaggagaacttgattttagccacattgcttcacaatatgattatgttcattattgtccgaatgaaactattagcggcgttgagattgttgacgtaccaaatgtaggtgaggcgatattgattgctgatatgtcttctaatattctatcccgtgaaattgatatgagtaaattcggcgtaatttatgccggtgcacagaaaaatctcggtccggcaggtatcactattgtgattgtgcgtgaggatttaattggtcaggcaagaaaagaaacaccgtcaatttggaattatgaagtccaaagcaaaaatagttctatgattaatacgccgccgacttttgcttggtatctttgttctcttgtattcaagcatttgcttgcactgggtggtgtcaaagaaatggaaaaacgtaatcaggaaaaagcaaaattattatatgattttcttgatcagagtgatttttatcataatgttgttgcacctaaaaatcgctcattaatgaacgtaacatttaccacaaataatgatgaacttaatgcgaaatttgttgcagaagcgacagcttgtggattgcaagctttaaaaggtcataaggtattaggtggaatgcgagcttcaatttataacgcaatgccgattgaaggcattaaagcattaattgaatttatgcgtaaatttgaagcagaaaataactagaattttatagcaaaaacgaccgcactttaacggttattaatttcaaataaggatttttatgcaatacatcaacatcgccaacgaaggcgtaaaatccctgtctccttaccaggcgggaaaacctattgaagaattagaacgtgaattagggattagcaatattattaagcttgcctcaaatgaaaatcctttcggttttcctgagagtgctaaacaagctatccaaaagcagttaaatgatctcacacgctatccggattccaatgggtttgaacttaagcaagtgatttcgaaaaagttcggtttgcaaccagaacaaattactttaggtaacggttcaaatgatttattggaattaattgcccatacttttgcttcggaaacagacgaaattatttattcgcaatatgcttttattgtctatcctttggtgacaaaagcgattaatgctgttgcacgagaaattccggcaaaaaattggggacatgatttagacgcttttttacaggcgattaatcataaaacaaagttaatttatatcgctaaccctaataatccgaccggcaattttttgactgaatatgaaatagatcatttccttgctcaagtgcctgaaaaagtgcttgttgtgctggacgaagcctatacagaatttacagatgaaaaagagcggttaaattcttttaaacttttacaaaaatatccaaatttaattgtttctcgttcattatccaaggcgtatgggttggcaggcttgcgtatcggttatgcggtatcgaaccctgaaattgcggatttacttaatcgtgtacgtcagccttttaattgcaatgttcttgctttagtttcagcggtagccgtgatgcaagatgatgcttttgttgaaaaagtagctgaaaataatcgtattgaaatggttcgttacgaaaatttttgccgacaacaaaagttagattatattccatctaaaggtaactttattactattgattttaaacgtccggcaaatgaaatttatcaagcattgctacataaaggtgttattgttcgccctattgccggttacggtatgccgaatcatcttcgcgtcagtatcgggttaccgaaagaaaacgataagttttttgattcattagtaaaagtgttaggcgaggtctttgttgggtgaagaaaagtaatttatacttttgcaatatccctatttacaacttaagaaagcaacataattttatggaaaaattaacgttatctccaattagtcgcattgacggcgaaattaatttaccaggttcaaagagcttatctaatcgagctctgttattagccgcacttgcaaaaggaacgacacaggtaacaaatttattggatagcgatgatattcgatatatgttgaatgccctgaaagcattgggtgtgaattaccaattatctgatgataaaacggtttgtgttgttgaaggtattggcggtgcatttcaatggcaaaatggattatctttatttttaggaaatgcagggacggcaatgcgtcctttagcagcggcactttgtctaaaaggtgatacggagtctgaggttattttaaccggtgagcctcgaatgaaagagcgtccaattaaacatttagtcgatgcgttgcggcaaaccggagcaaatattcaatatttggaaaatgatggttatccgcctcttgctattcgtaatcaaggtattttcggcggtaaggtacagattgacggatctatttcttcgcaatttctgaccgcacttttgatggctgcccctctcggtgagggggatatggaaattgaaattttgggggaattggtttctaagccttatattgatattacgctggcaatgatgaaagatttcggaatcaatgttgagcattataattatcagcgttttttgattaaaggtaagcaatattatatttctccgcagacttatttggttgagggggatgcttcttccgcttcttattttttggcggcagcagcaattaaagggaaggttaaagtaacgggaattggcagaaattccattcaaggtgatcgtttatttgcagatgttttggctcaaatgggggcaaaagtaacttggggagaggattttattcaagttgaaaaatcagagttaaaagggattgatatggatatgaatcacattccggatgcggcgatgactattgcaatcaccgcactttttgctcagggtgaaacggttattcgtaatatttacaattggcgtgtaaaagaaacagatcgactaacggcgattgcaactgaattgcgtaaactcggtgctgaggttgaagagggggaagattttatccgtattcagcctcttgcattggataaatttaaacatgctgaaattgctacttataacgaccatcggattgcgatgtgtttttcgctcattgcattatcagatacatcggtaactattttagatcctgcatgtacggcaaagacttttcctacctatttttccgagtttgagaaaatcagcaaaaatcaatagattaatgggcaatttattgcccgtttttttataattaaattctatattcaatttgtgtaataagtaaaaagtcattaaaatgggcgagtgtttattcaattcttgtaatattttattcgattatcgaaaaaaatccgctttgtgtaattactacgccggaggctgtaattcagtatggtgatgaacattttttaatgttaaagattttatttttttccgttaggagttagtcctcatgagtattcaaactcacataaaagcaaaacgttctcatgtgtttttcttaaaactgtttttgggcatcattgtgcttttatttgccgttatgatcggtttaaaagttgcttcaaaaatgcttattggcaagatgatagccggtatgcccgaaaaaacgacaccggttacggcaattacagttgtaccaactacctggacacctgttatcgaaacaacaggcttggtgagacctaatcaaggtgcggttttgagtgcacaagcaccagggactgttgcaaatatatttatccaatcaggacaacctgttaaaaagggagatgtgttggttgagttggatatttctgttgaacaagctaatttacaggcatcagaagcaaaattaaccacagcaaaacaaatctataaacgctatctgaatttgtataaaacgaagagtgtttctcagcaagaattggataatgcaaaagccaattatgagtcgttggtagcaaatattaacgccttaaaagcagcaattgagcgtcgcaaaattgttgcaccttttgacggtattacaggtattgttaaagtgaatgttgggcaatatgttaatgtgggaacgcctattgtacgtgttgaagatacaagttctatgaaagttgatttttctattgcacaaaatgagttggaaaagttgtttattggacaaaaagtgacggcaacaagtgatgcacgtttaggtgaaacgtttggtgcaaaaattaccgcacttgaaccagcagtgaatgcagcaaccggtttaattgatgtgcaagcaactttcgaagatgaagacagtcgtaagttactatccggtatgtttatgagattgcgtgttgcattgacgaccgaaaaagatcaaattgttattccgcaagtaggtattagctacaatatgtatggtgaaagtgcctatgttttgaccgcactttctgaggaagacaagaaaacattacttgataacgaaaaatttgcttataaagacagtatagacagggtttatcgagtaaaacaaactactgtatttactaaagatcgtcagggtatttatgcacaattaaaagggcaagatattaagccaggtgaccaaattgtggttggcggtcagcaagctattaccaatggtagtttagtggtggttgttgataaagaaacaataggcacacaacaacctgccaagaaaactaatctttaattttaggtaggaatatatccaatgaaatttaccgatatatttattcgtcgtcccgtattagctgtgtcaatcagtttgcttatcattattttagggttgcaagcaatttcaaaattgagtgtacgtgaatatccgaaaatgacgacaacggtaattactgtagcaacggtatatccgggggcagatgccaatttgatgcaggcatttgtaacctctaccttagaagaggctattgcccaagcggataatattgactatatgtcatcaagcagtgcggctaattcttcgataattacagttaaaatgaaactgaatacagatcctaacggtgctttagctgatgtattggcgaaagtgaattctgtgcgttcaagattaccgcataatatagaagatcctgtgatttcatcttcaacaggtggtacaggaattatgtatatcagtttttattctgataaattggattccagtcaagtgacggattatatcgaacgggttgttaagcctcagttatttactattgaaggggtagcgaaagctcaaattttcggggcggctcaatacgcattgcgtatttggttggatcccgaaaaaatggcggcacaaaatctttccgcactggctgtaatgtcagctttatcggctaacaatgtgcaaacagcggctggaagtgcggatggttattacaccgtttataaaaataaagtcgggacaaccactaattctgttaaggatttagaaaatttaattgtttattcaaaagacgataatcttgtacgtttgcgtgatattgctactgttgagctaaataaagaaagtgatagtacaagagcaacagcaaacggtgctgattctgtcgttttagctattgaaccgactgcaacagccaatccattaacggtagcggaaaatgttcgtccattgtatgcacaaattaaacagaatttaccaagcagtatgtattctgatttgctttatgatcgtactatcgctatcaatagttctattaatgaagtgatcaaaactattattgaagctactgttattgttttggttgtgatcttactatttattggttctttacgtgcaattttaattcctattattactattccaatttcattaattggcgtaatcatgattttgcaattatttgatttctccattaatttgatgacgctattggcaatgatcttagctattgggttagtggtagatgatgcgattgtggtattggaaaatgtggatcgtcatattaaagccggtgaaacaccgtttcgtgccgcaattattggtactcgtgaaattgcaatacctgttatctctatgacaattgcattgattgcagtgtattcacctatggcactaatgggcggaattacgggatctttatttaaagagtttgctttgacactggcaggtgcggtctttatttcaggcattgtagcattaactttatcaccaatgatgacaagtaagttactaaacaataatgcaaaacccaatcgtttggaacagcaaattgaaaaatcattaactcggttaaccaatgggtatgtttatgttttaaatttagttatggctaaccgtaagtgtatgcttacttttgctgctattatttttgccatgttaccatttttgtttacttccctttccagtgaattgacaccagcggaagataaaagagcatttatcgctattggttccacaccttccaatatgaatgtagattatgctcaggaggcaacgaaacagtatgttgatctgctgaacaaaacagaagaagtacaatttacaatgtctattgccggttttccaagttctagcgatacattaaatgttgtaaccttgaaagattataaagaagatggtcgtagtcagtcagagattatagaagagttgaatcgaaaggcaacgcaaattccggaagtgagtgtttctgcctttaattttcctgaaattgatacgggagaatccggagcaccgataggctttgttattagtacagcaaataactatcgtgatttagcaccggttgcagaagcatttttagcgaaaatgcgtgaatcaggcagatttgtttatacgaatctcgacttaaagtttgataccgctgaaatgcaaattagcatagataaagaaaaagccggaagttatggtgtttctatgcaacaaattagtagcactttagggagctatttatccgcagctacggtaagtcgtgttgatatagacgggcgagcctataaggttatagcacaagtcaaaagagcggatcgtttaacaccggaaagtttgaaaaatttctatgtatccgcaagtaacggaaaaagtattccgttgagtagcttaattagcatggaattggtaacacaaccgacatcattgtcaagatttagtcagttaaactcggcattaattcaagcagttccaatgccgggagtttcagtaggtgatgcggttcaatggctgaaagatgcagcgacggagttactgccaaaaggatataactatgattttcgtggcgaagcacgtcagcttgtacaagaagggaatgcgttagtaataactttcgtgttagctgttcttattattttcttagtattggcaattcagtttgaatctattcgggatccattggttattatggtttctgtgcctttggcggtaagtggagcgttactggtacttaacttcttgagcttattaactgatatgagaattttagggttatcaggagttaccctgaatatttactcacaagtaggattaattacactggttggattgattactaaacatggtattttaatgtgtgaagtagcaaaagaagaacaactttatttgggtaaatcacgaattgatgccatcactgaagcggcaagagtgcgtttacgccctattttaatgacaacagcggcaatggttgctggattaattccgctcttgttggcatcgggagccggtgcggcatctcgttttagcattgccatcgtattagttgcagggctttcaataggcactttatttacgttgtttgtattgcccgtaatttattcttatattgccagtgaacacaaacctttacctgagtttgatgaaagtataaaaccattggcaactgatcagcatcattaaattcaagcgataaataaccgcacttttaagtgcggtttattatttcaactattttatttgcaaacgcaattgggttttctaaatgagcattgtgtccggcacgttcaattaaaaataaatttaattgattttcttgtgccattttcttaaatttttcatccttttcaccacagaaataataaatgggcagagaaaaagaccgcactttttgatgaaaagatggttgtttggcaagtgacgttgcgattagcatttttgcaatattttggcctgattgatgtcttcgttgagaaattaattgttttcgctctcgtgcagataggtgagcaaaaacaggttgctgataccaatcatttaaaaccttggacatagtttcttggctaaaacgttttgcccaagccaaatcattctgccagcgttcaaggcgttgttgttcattttctacgcctaaatttgcaccttccaagataagtgcaacaagtttactttgtggatatttagattgcagtgcgtaatttaaggcaagacgtccccccaatgagtaaccaacgagaatataaggcttatcggcaatttttgcggtaatttgtcgggatagatattgtgcactttgttcaaaatcttctatgtgatagtttgtttgttcaccatgaaagggcagatctaaacatagataagattgtgaggaaaagtgcggtagattttttttaagttcttcgataatgtattgccaatcttgttttgttccaagtaatccatgtaaaaaaactaagatcggcatcatacgctatacctcttaaacaccgattaatgcatgaccaattttgtcaataagatctttatagatattactaccatcatttggattgattttaatttcgatgatggtcgtttctcggcgtgagtaggcttgtttaagtaccgtagccagatcagcccaagtataagggcgagcatatttgagatcgaacatagctgcaatatgtgaaaactcaagatagtgcgacatacggtaatatttttctttcactgcgatatcaacaggaagcatatcaaagattgctccaccattgttattaatgacaaagataattgccggttggtttagttgtttgaataatgcaaaagagtttaagtcgtatagcgtggaagtatcgccaatcattgctaccagtgtttgttcggaaccaacagcaattcctgccgcagtcgcaagcaaaccatcaattccacttgctccacgattagtgtaaattggataattggcggaaggttggcttagtgcatcggcaaggcgtacaaataaactgttccccaaaaagagaacgctattagattttggtagtaataattcaatattatgtgccaatgaggcttcatttaaatttgaacctacacgttgtttgataaagtccgcacagaatttagccaatgctaaaggctcaagtaaccaaggttttttccgcattggcggatgggctcgtaaccagtgatgcggtttagcattgaaacgtgtatgagcatgatgatagggatcaacagctttttgattattttcaataatccagtattcacctttaaattctgctaagaattgattaattcgctttccaataaatcctgagccaaattgaatgacgatttcagcttgtaacagtttttttctgacagtttggtttgccagccaaatatctgcataaggtagggttggtttaacatgggattgaatgtctgtaatcattatccaccccatattttctgcccattcagcaattcccattgcctgttcggaaggtaagcgtccaacaataattatgccttttttggttcgccattgatcccaatatttatgtgtaataacttccgtgtgttgttcttgatgttgaatccaatttttgttttgtgttagccaagattgaatattactgagccaaggatgaagatctatttcatcattattggcattatagagcggttcagcaaaagggacattgatatgaataacgcccccttgcttttgtcggaaacaagcctgatctaaaactgaaattagccattgagcagaatagttttgacttggacgaggcagatttatgctggctatcgggtattgtgcaaacatattttgttgcaaaatagcttgattagcaccgcactcaagcaattcaggaggacgatctgcagttaagataattaatggcacatctgtttggcgtgcttcaataattgcagggtaaagattagctgttgctgtaccggatgtaacgattacagcaaccggttttttgctcgctttagcaattcccaatgcgaaaaatcctaagcctctttcatcgaaatgagtatgacaggtgccacgtccgttttcctgtaaacggatagcttctagtgtaagtggtgtggagcgtgaacccggtgcaatacaaaaatgagaaacaccttgacggctcaaggtttccaaaataacttttgaccaacaacggttaaaaacgctggctgacatattttctactccgtttctttctgtaatagggatattagccctagtgctttacgttctatttcttgccattctaataaaggaatagaaccttcaacaataccggcaccggcaaatatacgaatataatcttgttcaataaatgagctacgaatagtcacacaaaactcagattctgtttcagtcattattcccaatgcacctgcataccaagtgcggtcaaaagtttcggtattttgcaagaacacttttgcttctttttgtggtaaaccggcaatagctgcggttggatgtattgcatttaaacatactgcatcagtatttcctgctttaagtcgggcagaaatttctcgttttaaatgttgaatttggcgtagttgcttaatttccagttcactcaccgtaatttcctcaacatagggtataagatgttgacaaatgccctctacaaccaagctgttttcataaatatttttcggatcttgtaataaccactgagcttgttgctgattaatatgttcatcatttgttataaaagctgtccccgccaatgcttcagtgattaggcgattttctttacgaacatataatctctcaggcgtggagcctataaatgcttgtgtattattttgagcaaacaaaaaatgatagcaacctgtattgtacttctcactttcagctaaaaaatccttagcgtttaatgggctatcagttttaaagtcggtttcatttgccagcacaactttagtcagatttttttgcttaatttcatgcaatgctttttctacccaaagacaccattccgtttgatttgcttttgttgttatcaattgaattgattgatgaattgggtttaattgaacttgtttttccaaagaatgaataatattcaacagatcatatttttcttgttcccaaggttttttattatcaataatgagttgaataacaagtttttgttcttgtatgaatgataaacgtggcaaaataaatagaggttcaccattaaattgacagccgccgataagagataaattaaattgttgcacaaacgtttgtgctgatttaacttgcgtaaagcgacatacttctccaagccctaagatttttttattggtatcacgaaaattaagataaaattgcggataatgatgttgagcttttaaccaaccgagtaaattcaattcttcatctaaatccaaatgaaggacggaaaaatcgtttttagggtcaaattggtattgattaattaagcgaataaactcagccttaatctcgtgcaaattatccattttgtatcgtattaagttaaacattcagttaaaaacagctgttaattctaccgcactttaaaaattttttttataaaatcttttcatctttttaaaataagcgtaaagtgtggctatattttgagtgacattattattaaaaggatagtctatgcgagttttccctaaatccgataagttagaacatgtatgctacgatattcgtggaccggtacatcaagaggcgttacgtttggaagaagaaggcaaaaagatcttaaaattaaatattggtaatccagcaccattcggttttgaagctcctgatgagattttggtagatattttgcgtaatttgcctgccgcacaaggatattgtgattcaaaaggtctatattctgcacgtaaagctattgttcaatattaccaatctaagaatattttaagtgcgaccgtaaatgatgtatacatcggtaatggtgtttctgaacttattactatgtcattacaagcattgttgaatgatggtgatgaggtgttaatcccaatgcctgattacccattatggacggctgctgcaacattagccggcggaaaagcggttcattatttatgtgatgaacaagctgattggtttcctgatgtggcagatataaaaagtaaggttacttctcgcacaaaagccattgttattattaatcctaataatccaacgggagctgtttatagtaaagaattattattagatatagttgaagtagctcgccaaaatggattgatgattttcgccgatgaaatttacgataaaattttatatgacaacgctgttcatcatcatatcgccgcattagcaccagatttgttaacggttactttcaacggcttatcaaaatcttatcgtgtagcaggatttcgccaaggctggatgattttaaatggaccgaaacagcaagcgaaaggctatattgaaggtctagatatgttggcctcgatgcgtttatgtgccaatcatcctatgcaacatgctatacaaacagctttgggtgggtatcaaagtatcaatgaatttattttgccgggtgggcgtttattggaacagcggaacaaggcttatgagttgattaaccaaattccggggttaagttgtacaaagccaatgggagcactttatatgtttccgaaaattgatactaaaaaattcaatatctatgatgatgaaaaaatggtattggatttattgcgtcaagagaaagtgttattagttcatggacgtggttttaactggcaacaaccggatcattttagaattgtaaccttgccttatgtgaatcaaattgaagacgccttaggaagattagccaaatttttaacgcattatcgtcagtagttgtgaaacaagagagaacattttgctctctcttgttttgtcttttaaccttcttcacaaaaattttcaggtaaatttgtcagtattcctttccaaatagcactactacgttcacgattttccacaagataaacactggcttgttgataatctccatttcgacaacactctttcaattgttgatagaaagtgagttcaacttggcgtgattgcggattaataaaaaaaagtgcggcgacttgatgataaagtgttctaaaactgtttaaaatcaaagtatatacgggcttatccgatataaagctaaaacgatgatagaggttatagtcaaattccgcataactcttttcatcatcatctaattcatctaaagattggaaaaattcaaacgtttgttgaggattaatttttattgcttcaggaataaattgttcacccattcgagtacgtaaagataccacatttgcaatgacggtaggtttaagagtaggtgataattgaatgagtgtttttaaaatattgggaccagctgtttcccaaatattgtttactttggttggtttaccatgttgaatatttagccaaccatcacgattcaaacgctgtaatacttcacgtaatgttgttcttgttacaccgattttgcctgctagttcacgttctgcaggtaaatctgagccggcaggaaaatgattattccaaatgcttttgacaatatattcttcggctaacgcagccggactttgtgctttaagaatatccatacttctctttttgttaaacatactgtaataactaggtgggcattatccttgaaagcgatttatattacaatcatttaattatgttttttgctttcctttataagtgttttattctatattactcgtgcgtttgtatttttgtgttttgagtttttatgaaattaatttgatgacattaaggatcataggcatgctcatcttttttaaaaatttatcaatgaaacgtagtacttggatactgctgttcatttcagcattagtgttagaaagtaccgcactttatttccagcatggcatggggctgaatccttgtgtgatgtgtatttatgaacgtgtagctattttaggtatcatgttttcaggattgattggatgtattgcaccaaaatggttagttttacgcattttagctttacttattgggttaggtagtgcggtaaaaggattattattagcaatcaaacacttagattatcaacttaacgtatacccttggaatcaatgtgcaatggttcctgattttcctcaaaccttaccattggataaatggtttcctaatatatttatgccttcaggttcttgcagtgatattacatggagttttttaggattttctatggtgcaatggattattgttatttttgcatgttatttcctatttttcattattctcagtataagccaatttaaaaaagtcagaaaaaacagaatgctgtttagatagttctgctcgttgaaatttttctcaaagtgcggtgttaaaatacattatttttgtaccgcacttatgttattaaaaaatcattccttaaagcttacttgttcctagcgtgaactcctcttctttagggggattagacgtagggaaaatcaagatttaataaatcttatagattattttgtgtctaagatctttagcaaaacgctttaacttacgtataaacggtacgttttcaactttccattctttgggcggattttcaagttgccggaataaatgacaaaataaattcgcttttagcattgaacatttttcatgccatgatttttttggaccaacataatgaataatagcaagaggcatagtcgcttcttcatattgattcagttcttttttacttaccctttttagtctatttaatgcattggcagtaaaattatatcttaagtctaaatattttacattattcgcaaaaatagcatttaaaatatcctgatcttgatacaaaaattcaatattattacgttcacaatattcaatccattgtaatgatttttcaaaaacatgacatttttcccattcaactacattaattaataatacgccggcattaaaataaaaatgtgtattaggtagatgaagttttgttttataatctgactgactgactgactgactgactgactgactgactgactgactgactgactgactgactgactgactgactgctcattcttttgcttttttcttgggattcaataaaagcatcataacaagctccgattgccttgtttcctaaatcagtattccacaacggcaacagactatgattgaccaatatgtcaatatccaaataaataattttcgttaaattaaacttttttaagtagtttgccagattcaatctagcgtaggttgataaagaaatatattctattgttctaggaaatttttcaaaatcacttatattaataggggtaatatccaaacgacagttgtttttattggctagttcaatgcaataatcctttgcaacagtagaaatacccatatccaacaaataaaaatgaatagtataacactcattgtttttatctctagcgtgaataatacttaacatagttactgctaaatattttgcataattgtcatcacatgaaaagagaatgttcatttgtttcttcttcttattaaggattttaatgttttactcagtatttttcttttttgtaataaatttaaatgtttatattttaaaatatataagagaaattcaatagagccacaattttgataaattaaatttagtatcatattgaaaagaacaacattaagcgatttaaaatcacttgctggtaaaatattttttttagatgaaataaattcggcaaaatcagataaatcattaaaacaatagttttcttggaaagagtagttaatgcctaatttttgtaagagaaagttggttgcttctattcttattcttctagctgatttttcttgtatatcactatattttgaagatatttgattatggtgtaccctatagtaagtaaatgattgagggatatttgccatttttcctcttttaagtatttctagccataatttataatcctctgcatgcggatatttttcatcataaaagagattatatttcttaaaaacatcgtttcggattaccatagtgggatgagtaaattgatttttaaatggaaattctcttaaaatttcttcatattctaaacagcctttccacacatctttatttttagtatattttcccacttttccaagtggaacatcattatcatgcaatatagtaataaatccgccaacagcaagcaaatccggttctctttccattttttctacaatcgtttcaatccaaaagggttcaacaatatcatcagcatcagttcttgcgacatattttccattacaatatgttaaacctttattaagagatttaataagtcctaaattagtttcattttgtaatactaataattcccccccctagcgtattcatgtgataatctatttaaaatttcctgagtattatcagtagatccatcatttactacaattacttcaatattattataagattgaagcataattgcacgaatacattcttctatatatttttctgcattatatgctgaaatgagtacagaaactaagttattcattatttttaacctctctataagaattttacaatacgccaaccattcaattttctttttaatcttcttctaaatcgtcctatttccttcgaaatacttcgccataaattccttcttgcttttttattattttctctctctctctctctctctctctctctctctctctctctctctgcacgctctactgaaataacgctggttaacttgcagttttcttgatttaaaacattatcttgaataacaattgcaggagaaatttgataaacgggatattgttcttcttttaataatgattcaaataaaatgacatcaattggctcaactgaaaaatcaggagatttaaataaatctaataatttttttgcggcaatttgtgaaataatatatcctgcagttccccattgttgagacattaattgaggaaaacaacgctgttgaaaaaatttaattttagttttgcgatatgctgaattcattaaataagtttctaaacgaagaataaaatactgattcacatcaaaccgctcttttagccaatcatattgcccaagaaattggtgggcgactggactgagaataatgtcatcttcaaaaatagcgataaaaggtaaattttcatcaacacatttttgccataatagaacatggctcataaaacagcctttttctcctattgtcagatcggttttatttaaagatgggacatagtattgaataatattttcattttcttcattaggttgaaacgcattaaaaaaggaatatggaatattttgttcgccaaaatatttttcaatatgttgacgtctttcaactgaactttttaaactgataacatgattaaacattatatttcctaaaaataaaataacgtattctaacaatgatatgctatttgcagagatattattataagaattttatgcgacgataatctttcaatatccttcttctaaatcgccctatttccttcgatatacttcgccataaattcttttttgcttttttattatttttactctctctctctctctctctctctctctctctctctctctcgggtgcaagagaactggttaatgtgcagttatctttatttaaaatacaatcctgaataataatggcaggctcacattgataaaccggatattgttcatcttttaataattgcttaaaaataatttgatctatttcttcaatgaaaatatccgtatttttaaataacgctaataattttttagctgcaacttgagaaagaatatagcctcccattccaaaatgtccagacattagccgattaaatttacggttttggtagtcgggaatttttgtcttgcaatattctgatttcatataaattgtttctaagcggagaataaaatattgattaaaagctaaccgctcttttaaccaatcatattcactcaaaaatttattggcgaccgaactgagaaaaatatcatcttcaaaaatggcaataaacggtagattttcatccacacatttttgccataataaaacatgactcataaaacagctctttagtttatttgcgagattgcttttacttaaagctgggacatagtgttgaaggatatgtttattttcttcattaagctgaaacgcatcaaaaaaagtatagggaatatgttgttggctaaattctttttcgatatgttgacgtcggtcgaccgcactttttagactaataacataattaaacatagtttactcattttttatatataaaatgtagtggtttgctactcaattaaattgacagtataaaaaataatttctaaaatagccaatattttgttgagtttactgtgaattatgttagataatgccaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcagtgatttttgtcataaatttagaaaaagcaactgaaagaaaacattttatttcccaccaatttaccgcacttcaagaacagcatcctgacatcgtaataaattatcagttttttacaggggtaaatggaaacacccaaccaaatcatcctttatttgctaaatacaatcaaaagaaacgctatcagcgaaagggaaatgaaataactttagggcaattaggttgctatgcaagtcattatttactatgggaaaaatgcgttcaattacaacaacctattattgtattagaagatgatgctattttgcagcccaattttttagctgtttatcagttctgcttttctgcggaaaatcaatttgaatttttttggttaacgcactctaatagttcaaaaattagaacaaaattaattcacacgttacccgatagtacaaaattagaacaacattatttcggttatagtaacacgacaggttattatcttactcctcaagcagcacagaagtttttagactcttctcaagaatggatatataacgtagacatttttatggatcgtttttatgaaaatcatgttgctttattgggcgtgaatccgccttgtgtcaaacccgatttttctaagcaaagccagattacgatgaataaaaataaccgcactttttgggttaagttaagacgtgaatattttgcacttcttgagcgtatcaagcgttttgtttattggacgtgttattgttgatgatagatatggataaagtgctaggtttacgagcagacaaaactggaaacaaaataggcagggaaattattagaatttccagttcaaattgatctgacagtcagctgttaaacagagactgtcagattagttgctttttattcttgtttgtttagtaaaaatacgccattttcactgaaatgaacgtaggcctcgtgcatttcttgtgaaaaattctctggattagcattgatcagtaaatctttaccgccccaattagctatgatttcccaataacttcccatatagaccgcactttttattacacaacgttgttcttccataccttctgattttagtttgactgcttcaggacgaatacccactaaacattctccatcgttcaaagcgaatttatccgcatcaggtaaaataaattgatagtcgttaatggtaattttgccttgttctaaataaccattaaaaatactactttctcccataaaacttgctaagaatagtgagttaggatatttgtaaagctcttttgctggtgctttttgcatgattttacctttattcatcacgatgacttcatcagataccgcaaaagcttctgtttgatcatgagttacatataaagaagtaatatttaaacgctgttgtaattcacgaattttttcacgcattgaacggcgtaaattcgcatctaaattacttagaggttcatcaaataataacactttcggctttaatactaatgctcttgccagtgctactcgttgttgttgtccacctgaaatttgatcgacatagcgatcttcaaatcctgccaagtcaactaattctagtgcctcttttactctttgtttgcgttcatcagaacccacaccttgcatttttaagccatagccaacgttatcgccgatggacatatgcggaaacagtgcataagactggaatacgatacaaatatcacgattttggatggaagattttgttacatcttcaccatcaataaaaatttctccctcggttggactttcaagtccggcgactaaacgcaataccgttgttttaccacaacctgacggtcctaataaagttaccattgaaccacgttttatgttcaagtttaaattatctattactacggatttaccaaacgatttggtgatatttttgagtactaaaaaatcattattcatatttatagcctttcgttaaaattttttatttttctaccgcacttcgttattcaagtgcggtaccgattaattcatttttttcgcttttgaacgggaaatgcgagtgtcaccaacgatccagtcgaagaataaaataattgccatcatcacaacaattaaaattgaaccataagcaatggctatgccatattcgccatcttcaactcgattcaaaatataggcagtagctactcgtgtatccgctgtaactaaaaaaacaatcgcactgacggttgtcattgctctaacaaagctggtaaccaatgcggaaagtaatgccggttttaataatggaaaaacaataaataaaatagtttttaatgaactgccttttaaagaaagtgaagcttcatctagagatttatctaattgtccaagtcctgcaaccgccgctcgcataccaacgggcatgttacgcattaccattgaaagaataataattagtcccgtacctgtaaggtaaatcggtgcatcattgaatgcaatgatataagaaacaccggcaacggtacctggtacagcaaagcaaagtaaggttaagaattctaaggtttttttgcctttaaaatctcgtcttactgtaatatatgcgatgagcaatccgaaaatagccgtaattggagccgcacttatcgcaaaaataaccgtttgaattaatgacggccaagcaccatcactgaaaccttgaccaaataacgttatgtaattttgtagggtgaacgtgtaatcaacgccccagttttttgtaaagctaccataaaaaatactgccatataagaccgcattaaagaggatccaaaaacctaacgtaaagacaacgatatattttaaggtcgttggtaattcttgtacgtctcctcgataggattttcccgatactgttacataagaacgattacctatccaccaatattgaatgataaagattgcaagagaaaatatgagtaatatcgtacctaacgtgctggctgaagcataatccaattgagaacccgcaatgtaaaaataaatttgtgatgaaatcacatcaaagctaccgccaagaactaatggcgtactaaaatccgccaatgattgaattgccacaactaagaatgaatttgctaatgctggctttaacaacggaaaaataatattaaaaaacgtttgatagcgatttgctcttaatgtataagatgcctcttcaatagatggatggatagattttagtgcaccttctaaaatcataaatgacatgggagtaagtgctaaagtatgagcaattacaatacctgtaaaaccatatagccagttactgctaaacccaaaatactcaactaaaaatgaagttacataaccggaacgtcccaacattaatgttaccccaagaccgactacaaaaggtggggtaacaataggtaaaatagagaatattttacctattaccgctgttcgcttagcaactctggtagtataaagtgcaaaaattaacccaaataatgtcgctagagttccaattgtaaatgcaaccgctaatgagtttccaatgatgcgtaaaacatatggtttactcacaatgtccaacacttggccaggtacaaatgtcgagccatcgtagaacatagaaaggaaaatggcgaaagttggataaacaataaagaaaaatataagtaaaatgatacttattagagaaaatataatgaacttatctccttgcataaatttcatttttgccaatgcgttggttgctaatgcaaccaacgtaataaccaagataaaaatggaatatccaagactgaacttttgcaaaatagcagacaaaaatacaaaaaagaagattcctacaacagcaaaaaattcaacttttccttgtttttgttccccgctatgttgaaataaatgagaaagtattggcacaatgagtaatgaaccaaaccaaagccaacttaaattaaacttagtccatcccattgcgtcataaatttcttcagatgtagaatctgttataccatagtgtaatgtcatagttggtaacacaaaaaatccaataaacgacaataaaatccatcctaggctacctttgaatattcgtgtctgttcactcataaaacctccgtgaaacaaaaattactttgctaatttaacttctgtaacccatttatcaataatcttgctgcgaacttcatttgatccaaatcgatcaaaatcataatcgattaagtttaattccgttggcttaagtgaataaggcgatggttcagcattagcattagttggaatatgatgggattgtgccttttgccaagaaagttcttgagcttcttttgacattacccagtcagcaaataattttgcatttttcaaattacgtgcatttttaatgatactgattccgcccagttcatagcccgttccttcacaaggaacaacaagctcaataggtgctccatttgctttttcaaaagagtaattttgtaaaaagcctacacctattgctgtttctcctcttgctgtatttcttgaaggagctgtacctgctttaggatattgggatacatttcgatgaagttttttcaagtaattaaacgctgcatcttctccccataattggataaatgttgcaattgccgtgtaagcagtacctgaactttgaggatcagctaattgaatttcgttttttagccgtggatctaagagatctttccaacattttggaacttcagtaatacctaatttttttaacctttcggtatttacaccaaagcctaatactcccatgtatacaacagaactctttccatttcctaatttttggaactgaggaagcacttctgccaatttcggtgatgtgtaaggttcaatcagacctagttccaccgcttgtaagtgcgtgtcgaatggaccgccaaaccacacatcagcttgaggattatttttttccgctaccatttttgctaaagtgctgcctgaactattgcgaataaatgatgcactaacattgtatttctcagaaaaaccttgaacggctttttcacatactacattttgagcactacaataaaccactactctccctgccgattttgccaaggtttgagcgtgaaataaacttgcaaaaaataaagcggaaagagataaagcaaattttgataacttcatacttattctcctaagtaaaaaatatttttatttagccaatttaacttcattaatccattttgtaattaaacgtttacgttctgcaacgtcaccatatttttcaaaattgtaattaataagttttaatttcttaggatcaaaagctaccggtgattgttctgctgtcgtgttagttaatgtttggaatgattttccttttttccaagctaattcttgcccttcttttgataacgcccaatctacaaacaatttagcattttctaagtttcttgcacctttaataatactgacacctcctaattcataccctgttccttcacaaggcacaatcatttctattggtgcaccttgttgtttttgcaatgcataatcatgtaagaaacctattcccacagctgtttcaccacgagcggtattattagagggggtaattcccgattttgtgtactgtgaaatatttgggtgtaactgtttaaaataatcaaaagctttatcttctccccaaatttgaataaaagttgcaatcgctgtataggcagtccctgaactttgtgggtcagcgatttggatttctcccttaagacgaggatcggttaaatctttccagcattttggaatttcagtgatacctaactttttcaatcgttccgtattaacaccaaaacctaaaattcccatatagatagcagaggtataattacctttcactttagccggatcttggaaacgttctacaatgtgattaatattgtcggaacgatatggcattaataatcccatttctgctgcttgtgcttgaggatcaagcgtaccgccataccatacatcggcttgcggattatttttttctgcttcaatttttgctagagtactgcccgagccgtttcgaatgaaggatgtttttacgtcatacttttcaccgaaagccttggtttcagcttcacacatttcattagttgcactacagtagacaactaaacgcccctttgcattaacttgagtcgttaccattaatcctgttgcaaaaagtgcggttgatattgcccaagatatttttttcattttcatatggttctccttgtttgaaaaatacctgttgtaagacagtgtaggaatgataacacaagaaaaaataggatcatgtgaggaaagtcacacaatacaaaataaaagggagtgatacataaatcttctgagaatgactgtcaatacaggtaaattttctttataatcggcataaattttcatttaaattaggtggaatattatccatgtcagatcagtcttgtattattattgccattgctggtgcgtcagcatcggggaaaagtttaattgcatcgactattcatgaggaattgtgtaatgaattaggctgtgaggaaattgggattgtgacggaagacagttattacaaagaccaaacgcatctttcttttgaggaacgtattaaaacaaattatgatcatccaaattcaatggatcgtgatttactaattcaacatttatgcgatctaaaaaagggtaaagccgttgatattccagtttatagctatgttgaacatacaagaacccaagaagtaactcggtttgagcctaaaaaagtaattattttggaggggatcttgttattaacagatgagcgtattcgtcaggaggtaaatatgtcggtttttgttgatacacctttggatatttgctttattcgccgtttacaacgtgatatggaagaacgtggtcgctcattacagtctgtcattgatcaatataaatccacggttcgtccaatgttcttacaatttattgagccatcaaaacaatatgctgatatagttgttcctcgtggtggcaagaatcgagttgcgattaatatgttaaaagtgcaaattcaacatttgttaaataacaaataaggaacaaatatgagattatgtgatacagatattgagcgatatttggatcaaggtattatttctttaacacctagaccgagcaacgaaaaaattaatggtgcaactattgatgttcgtttgggaaattcttttcgtgtttttcgtgaacatactgcacctttcattgatttaagcggtcctaaagaagaggtaaccgctcaacttgatgcggtaatgagtgatgaaattattattggagagaatgaagctttctttttacatccgggtgaattagccttagccacaacattagaagcagtcaaattacctgccaatattattggttggttagatgggcgatcttcgctggctcgtttagggttaatggttcatgttaccgcacatcgtatcgatccaggttgggagggaaaaattgtcttagagttttttaattctggaaaattgcctttggcgttacgtcccaacatggtgattggtgcattaagttttgaagtattaagtggtactgctgcgagaccttacacaagtcgcaaagacgcaaaatataaacatcagcaaagtgcggttgccagtcgtattagtgaggacaagtaagggtatatctgattatgtggaaaaaaatcttcttttttattaccgctctttttgtcggcatagcaattttcacgtatgtgcagattgaaaaaattcaatcaacgttagtcgcaagattaaatgctaaccaaatagcggttgacaacattactattgattttttccctacaaagataacgcttactaatctccaatattctaaacatccttctcacattaatattgacacggcaaatattgaaataagcgtattgaatttattagcgggtaatcttgctgtaaaaaatattgttctaaacaacatttcccactcatatccatctttcccagctgttcagtacttaacaatgatagggaaaattacacaacaaaatagcaacattttctttgataatgtgcagctggaattgcaatttgctcaccctgtttatttggataaaagaacatttaattttcatattattgaaggattttttaatcaaaatgagatggagactcctaaatttgaaggaaatatcgtcataaatcagcaacctgtgctcattaaagcggagatctatcaatcaaaaaacgaggaaaagggactaaagattttgtttaaagctagggattgtgagcaatgtgcggcagagtttgaatataattcaactcgtgatcttccatcggtgtttacagaaggaactttgcaatttagtagtcataattttcccattgaatattggcttaaaatggtagatttagatccacttataacaggaaaagctgatattgttgcgagtggtgtagtaaaaaataatcggttacaaaaactggacatgccaattacggttaaacaaggatctctatccggcgttaatttgttggagttggcgagcgggattttacctatcaattacgatagagaaaatgcaccgagggatatggcttttgaacatcttcaactcaacgcaaattgggagaataacttattgtatttagaagatatatttattttgactgagaatattattattgagggcaagggaatttccgatcttgatcagatgcaatgtgatattaatttagttatgcgaccgaccaataaaaaatatcaaaatgtcagtttaaccgtacatttctttgatcagtgcaatcgccctcagtatcaattgaaaatccgagcaaaagattatttaaagcaattactaaaaagaaaattttcccattaagtctcatgttaatcatgcagtcttgtactgtgctgaaaaaataaactcaattttaaaataaagtgatatttactatacactttctttcttacctttataaaattattgccaataaatatcttttcaagataaaaatctaaaaataattaaaaattggaattaaataaatatttaattatatttaaaagcaaaaattcaaattaaaatgctgaaaatgacattgacttaaccataaaatttcctcattattgggtaagtaatttatgaggaaaaagttatgtttttattaaaaaagttcagtcatcttttagcaaaatacaccgcacttgttatcattgcattagcttgtgttactttttattccccaaatctttttacttgggtaaaaggtgatgcacaaattattgtacttggtctaataatgctatcaatgggcatgaccttaggtaaagaagactaccgtattcttgcaaaacgtccttttgatattttagtaggaactatcgcccagtatagtattatgccttttgttgcaatttctattgcacaactctttaatttatctctagggttaactttgggtttagtgttggttgggtgttgtcccggtggtgttgcttcaaatatcatgagctttctttgtaaaggtgatgtggcttactctgtgggtatgactactgtttctactattttagctccaataatgaccccacttttattgaattatttagtaggtgaaacggttgcaatggacggttgggcaatgtttaagtttatgttgttagtaacattggttcctgttggtattggctcaattatgaacataacgtttgaaaataaaaaatggtttcaagagttgcgtgaattaatgccaggtgttgcggttattaactttgcttttattgttggtggcgttgttgcggtacatggaaataaatttttagaatccggttttataatttttgtatgtattgttttccataatgttattggatacatcttaggtttctttacagggcgtttatttggaatgagtacagctaaaaaacgcactttatctattgaagtaggagtacaaaatgctggtttggcaacaggattaagttcaaaatttttcccaactaatgcggagtctgctattgcttgtgcagtatcttgcgtatggcattctatttcaggcacaattttagcaaatttatttttatggtgggataaacgcaaaaatacatcaactcaagagaacaatcctgctaaaaatttaatgaatagcacgaaataaaataataaaaatttataccgcacttgagtttgtaagctaatcaaggtaatgtatgcgagtttattttattattgttttatgaggttaatatgaaaatcattcttttgggggcacctggtgcaggcaaaggtactcaagcacaatttattacaaataagtttggcattcctcaaatttctaccggtgatatgctacgtgctgcaattaaagctggaagtgaattgggacaaaaggctaaaatcttaatggatatgggacaattggtacctgatgatttaattatttctttggtgaaagaacgtgtagcacaagaagattgcgagaaaggttttttactggacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttacaacccgccaaaagtggaagataaagatgatataactggtgaagatttaattcttcgtgcagatgataaacctgaaactgttctagatcgtttaaaaatttatcataataccactaaacttttggttgattattatcaagctgaagctgcacaaggtaacacgaaatactttcgattagatggtacacaaaaagttgaagaagtgagtcaagaattggacaagatcttgagctaagtgcttaaacagttcagacctctatgactacttaatactgagaacatagaggtctgcttttattcattgaatataaatatgctaattattgtgcaaccattaccatggcaggtctgataactcgcccatttaatagatagcctttttgtaaaactactgtaatttgattactttcaaacccttctgttggttgcatggaaatagcttggtgtaattcagggttaaaagtttcgccaattacaccgacaggttcaacaccgaagcgtgcaacagttgataaaagtccttttaaagttaactcaacaccatcgactaaacttttgatggtttcattttctacattagcaggagtagacagtgcacgttctagattgtctatcgtttccaacaaatctttagcaaatttctctaaagcaaatttatgtgctttttcaacatcttgttcagcacgacggcgtatattatcaatttcagcacgtgtgcgtaacaaaatatcttgttctttttttacagcttgaataagctgttcctccaattcttgcacacgagcaatagcattttccaacgcatctccatcctgtatttcggtttcttccattggtttttcttgctcattttgagtttcaagttcagctgaaatttcctcttgttcgactttttcttgttctgacattatttttttactccatttttagatttgtatcattgtatcaaaaaacatagaaattaacacccgcacttattggcaagtagagtagaatgtgtgtaatatagtactccttttatttaattcaagtgttctttgtagaaagaccatgacaccagcaaattttattgatagtaaaaaattaattatttcgtttaagacgattgccttagtaggacgccctcgtcatgatgtgaatttacaaatgcacaaaaatttatttcattggctttctgaacgtggttatcaagttttagttgaacgagaaattggtgaacgtttaggattgtcggtaaatcatttagcggatttagatgaaataggctgtttagcccatcttgccattgttattggtggtgatggtaacatgttaggacgggcgagagtcctagctaagtataatattccattaataggtattaatcgtggtaacttagggttcttaactgatattgatccgaaaaatgcttatgctcagttagaggcttgtttggaaagaggcgagttttttgttgaggagcgttttttacttgaagcaagtattgagcggaatggagaagttgttgcacaaagcaatgcaataaatgagacagttatttatccggctaaaattgctcatatgatagattttcatgtatatattaatgataaattcgcattttcgcagcgttcagatgggctgattatttccacaccaacaggttcaactgcgtattctttgtcagcaggaggtccaattttaactccgcagcttaatgctattgccttggtgtcaatgtttccacatacgttatcttctagacctttggttattgatgctgacagtaagatttcggtgcgttttgctgaatataatacatctcaattggaagttggatgtgatagtcaagtagcactttcttttacccctgatgacattgtacatgtcacaaaaagccaagataaattacgcttgttacatctaaaaaattacaattattacaatgtattaagtacaaaattaggttggcttaaaaatttagcttaaaaaatttttataagtctatttactgtatataaaaacatatatataattgtatttatatacagtaaaggattcatgctatgttagttcaacttaccattaataactttgcgattgttcatcatcttgatattgaatttgcgaaaggtatgtcagttattaccggcgaaactggagccggaaaatctattgctattgatgcactcggactttgtttagggcaaagaacagagttatctatgttacgtgacggacaagagagagtggatgtttgtgccacatttcatattgagagcattaatcctgcttatcaatggctacaagagcaggagttacaagattctgacaaccctgaatattgcattttacgtcgaattattaattctgatggacggtcgaaggcttttattaatggcgttgcagtatcagcctcacaactcaaaactattggacaatatctgattcagattaatggtcaacatgcttctcaacaattgctaaaaagtgactaccagattcatattattgatcaattttgtggacatgaggacttattgaaaaatatgcaagaaagttaccgcacttggcgagagttacaggaaaaagtaacgacatttcatcagaaatgtgctgaaaatgaagcaaaaaaacagctattagaatatcaagtagaagagttagatcagtttaatttgaaagaaaatgagtatttggagttggaagaagagcatactcgcttatcaaatagtgaagaattgatgtctttatctcagtcaacattacagttattaagtgaaaatgagagtgtgagtattgatagcctgctttataaagcaacacaatatattgatgagctttgtcaattggattctaattattctgatgtgcaaacaatgttgcaagaggcacttattcaaattcaggaagccacgtctgaaatacaacatttatcctcaaatattgatcaggatccaaaactgttacaggctgttgaacagcgtatgggacaagtgttacaactcgctcgtaagcataatgtgaaaccacaggatttagttgaattacataaacaactgaaaaatgaacttgagcaactcgttcatttttctgaaagtgaatcgcaattgatacaacaagaagaacagatgcgacaacatgtgcaagaaattgcaacgaaacttagcttaagtcgtcagcaaggggcaataaaattatcaacacaagtgacacaatctattaaattacttgctatggaaaatgcggagttctcaattacttttgatgaggataaaaaacttacaagtaaaggttatgatcaactctgctttaatttgagagcaaatctaggtcaatcagtacaacctttaaataaggttgcttccggaggggagctttcacgtattgcattggctatacaggttttaacctctgataaagcagctgttcctactttaatttttgacgaaattgatgtgggaattagtggtgctacagccagtgttgtgggcaaattattgcgacaattgggcaaaaaatgccaagtcatttgtgtaacgcatttacctcaagtagcttgctgtggacataatcattttgctgtagaaaaacaggttattgaaaataaaacaataactaaaatgaccgcacttacatcagaacagagagttattgcattagcaaaacttttgggggggcaaggcattggtgaaatggcattagctaatgcacaagaaatgttggatttagtcaatataaattgaatttcatttcgtgtatttcaccaaaacagattatattgtatccgattttagaactgatctattaataacagactctagcctcagtacataaaaatgcttatgaagtaaatagctgatactgtttcacttatattaattctattgtctgaggtagagaaaaccatacagcacggacttcacatcgatgtttttaagtctgattttttaaccctatataacctcgtttttgcaaagttgcttctttggattttctgatcattgtttctattgtcgtgccttgaattaaaattgaaaagagaacaacgctgtaagtaataataataaataaatctcgcacattcataccgatattttctaaaaatgcactcgttgcaggaatagaaagtgccatggcaagagagagaccgcctcgtaagcctccccaagttaaaattcgtaaagtataaggattgtacacagttttcatacttaagaatttgaatgggatccatacgcttgcataacgacaaaacaaacataccggaatagcgattagacttaagatgatcgcttgtgaagtaaagttcaccaataacatcgcagagccaattaataagaataaaagtgaatttaagaaatgatcaatcatttcccaaaagtgatcaagatagtgttgactttgttctgaaaaaccggagtgtcttgtccagttggaaatcataattccggctacaaccattgccaaggcaccagaaacatgaagcaaatttgctaacataaagccagcagtaggaatggttaaagtgagtaagatttctaaacttccgtcatcggtagctgaaatcagaaaatgagcaataacacctaagattaagccaaagaaaattccaccaacggcttcagctaagaagagttttgtaatctccattgcagttggctcatgtccaccaaatgcaacggtaaaaatagttgtaaaaataactaatcctacaccatcattaaataaagattcaccttctactttcatggataatttttttggtgcttttaagtttttaatgatggccaatacagcgatagggtctgtcggcgaaatgagagcgccaaataaaatacaataaataaaatctatatgcagccttaataaggcagatattccgtaaaataaaactccaataaagagagttgatgctatcgttgaaaacaaagctaatattgtgatctccaatttttggctttttaatacaggtaatttaattcccaatgcaccagcaaaaagtaaaaatcccaagatgccatttaataggaaatctttaaaatcaatgcgttgcataacgttttgagcaatgtcgtctaaatggaataaattagtggatcctgcgattagtaatatcagtgaacctacagttgctgttgcggtgattgcaattgtgtattgaatacggtcactgattttttgagtgacaaaaccgattaaaatcgatatggtagagagaaaacaaatgtaagtataaatactcataagaagtaccttctaaaatttaaaaatctgtttatattttattaattaatcaaattagtaaaatataaacagacttgacttgttctaattgagatagtcaagtagcgattgagcattagaaagttaataaaatgtaacaagaaaaatttttgcctagtataagtaaagtcctactttttataaagttcatttttataaaataattagaaatagttaatttatagcgttattttcgaccgcacttttgatatgaaaatgcttgtttaaggatagtaatggcagaataaattttgtttgttctgccattatatgttgaagaatgaaaaattaacattttgccacaataacaatttccactttccatttcgggtcagccaattgactttgcactgtggctctggtcggtgcattatgagaatcaacccattcatcccatgccttattcatttcttgatagtcttgcatatcagctaaaaaaatttgtgcattgagtatgttgcttttatttgaaccgatttctagtaataatttatcaattagacctaatacttcttttgtttgtaaataggcatctacatcagtattttccggtacttgtccagcaaaataagcagtattattgtgaatcgttatttcagatagccgtccgttagaatgaaagcgttgtattttttccataatgtctccttagtgaataatgaaattatgtataaagattatagcgatttttgtaaaaatggactaggatctgcaagtttttcttgaattattgtagtggaaaattttgtgtgaaattgctgatttctaaccaacatggtgcaactttaatggcattaatgccatttttatatggtatgcttttggctaaaccgacttggcagcattcctttttatttttggcttggtttagtctatatttaatgagctatcctttttttcatttgttcaaaggtaaaaaatcgaattttataaaatatcaaaaatacacattgatttatggcacgacaagtttgatatttgcactacctgttttttactacaattggcacattttatattttcttatcgcaatgttaccttttggcttcatcaatatttattttgtaaaacaaaaaaatgaacgagcattaattaatgattcggcggggataattatctttgctattgccggtatggcaagctattatttttctacttttacctttactcaacaaatttggttagttgctttattgccaagtttgtatttcatcggcactactttgtatgtcaaatcttgtttgcgtgaacgaaaaaatcctaagtatttattggcttcttacttgtggcatgttgcttgtgttgttctttttgttgcaatacaacagttttatcttgcatttgcttttgttataccagcaatacgtgcctattttttaccgaagatgaagatctcagctaaacaactcggtttaattgagattgcggtagcccttgtattttttattcaacttctttttgccactttatagagaagaggactactatgaaattactaatgttatgtcgagaacctcgcctttacagttgtcagcgtttaaaagaaagtgcggaagataatgggcatcagatagatattctggatcctaatcgttgcttattaaaactctcgaaaaatgcaccgcactttgagttgtattatcaagtgaatagtaaaagcgagccgtatttattaccggattatgatgcgattattcctcgttttggttctacaagcacaagaatggggtgtgccgtgttacgacattttcgtacaaaaaatgtattttgtttaaatgatgatgttgcgtttttaaaagccagagataaatggcttagtttacagttattgactgaacaaggtattgctgtccctaattcagcattgtcaggtgcagaattttctgccactcaagccattttgcaaattcaatcgccgacgattttgaaaacgttacacggatcacaaggaataggtgttattttggcagaaaatcgtaaaagtgcggtgagtattatggaaactttaactcaagcagacgtaccgttattaatgcaggattttattcaggaagcacaaggaacggatattcgttgttttgttattggtgataaagttgttgctacaatgcaacgtattggacaagaagatgaatttcgtgccaattttcatcgagggggaagtgcagaaaaaattcagttaaccgaacaagaaaaagtactggctttaaaagcaacgaaatgtttagggctagatgttgcaggtgtcgatttgatccgttctaaacaagggttgttagtgctagaagtcaatgccagtcccggattggaaatgatcgaaaaaaccagtggaattgatattgccttgcaaatgatagttcacattgaaaagcagtttaagagataatgttttgctcgtagtgcggtagaaaaataccttgttttttgttttaataatgaaatttaaaaaatcccgatatttacaaaggattcacaccttaacatactgaataaataggttaattatgttcttttggtatcaaaatcacgttatagctaagttacttgtttggctgttattcccattttctttggtcttttggtttatttctgttattcgtcggagattatttcgattaaactggctgaaatcctaccgctctcctgttcctgttttgattgtgggtaacttatctgtagggggaaatggaaaaacacctgtaacgatttggttggtaaaacaatttcagtcgagaggtattaaagttggcgttatttcacgtggatacggtagccgagcagagtattatccatatttagttaaaattgatgataatccaactatttccggtgatgaacctttgttaatcgcacaacgtacaggcgtacctgtttgtatttccccgaatagacaacaagcaattgagcttttactggcacagtttaattgtgatttaatcattagtgatgatgggttacaacattataaattacaacgtgattttgaaattgtagtgattgatggcgaaagggtatttggcaatggttttgttatgccggcaggacctttaagagaattaccaaatcgtttagcggaagtggatttaattattaataatggaaaactaacaggttatagtaatacgttaatgctcttattacctaaattcgccgttaatttagtcagtggtgagaaaaaactattacgtgattttcaacgtattcctctcaatgcaatagcaggtattggttatccgcaacgtttttttaatatgttacgagattttgcgttaactcttgaaaaaacgcaaagttttcaagaccatcaggattttgatgcagtacatttctcatatttctcttcaaatcaaccgctctttatgacggaaaaagatgcggttaaatgtcgtccttttgcacaggcgaattggtggtatgtgccggttgaggctgatattcagggagaagaggtagaacgatttatgcaagttgtttcacaacaaataaaggagaaaaaatgaacggaagattattagaaattgtcgcatgtccaatttgccaagggcgattgaaatacgacagtgaaaatgagcaacttatttgtcactttgatcatattgcttaccctattaaacaaggtattccaattttactttccgatcaggcaatcggtttgtctacatctttaaccaatcctgagcaacaaaatcagtaataaggagaatattcatgaatttcacggttattattcccgcacgttatgcgtccagtcgcttaccgggtaaacctttggctgacattgctggaaaaccaatgatccaacacgtttgggaaaaagcacaacaatccggtgcaacaagagtggtcgttgcaacagattatgaggaagttgcacgagcagttcgtggttttgatggagaagtttgtatgacttcctctcagcataattcaggtacagaacgtttggctgaagtgatagaaaaattagctgtacctgatgatgaaattattgtgaatattcaaggtgatgagcctcttattccccctgttattgtgagtcaagttgcacaaaatctacaaaaatatcaagtgaatatggcaactcttgcagtaaaaattgaagatgtggaagagttatttaatccaaatgtagtgaaagttttaacagataaagatggttatgttttatatttttctcgtgcagttattccatgggatcgagatcagtttgttcaactgggtaaagcagatttatctcaattgcaattgcaccaacattatttccgtcatattggtatttatgcttatcgtgccggctttattaaacaatatgtacaatggcaacccacaacattggaacaaattgaaagacttgaacaattgcgtgtcctttggaacggtgaaagaattcatgtggaattagcaaaacaagctcctgccgttggggtagatacggtagaagatttagaaaaagtgcggtctattttatctcatgtttgatgccaaaaactttcttgccaatgtaacgcaccagcccggtgtataccgaatgtttgatgaaaaagggcaggtgatttatgttggtaaggcaaaagatttgaaaaagcgtttatccagctattttcgcactaatttgaacagtaaaaaaacttccgcactggtttcgcatattcattcaatagaaacaacaatcaccgcttcagaaactgaagcattattgcttgaacataattatattaaagcttttcagccccgttacaatgttttattacgtgatgataaatcctatccctatattctattaacgaaagaacgtcatcctagaattacctcgcatcgaggttcaaaaaaagtacaaggtgagtattttggcccttatccccatgcaggagcggtacgtgaaactctctctttgttgcaaaaattatttcctattcggcaatgtgaaaactcggtatataacaaccgctctcgcccttgtttgcagtatcaaatcgggcgttgcagtggtccttgtattgatggtttagtatctgatgaagaatatcagcaacaggtcgattttgctcggctatttttacaaggtaaagatcagcaagtgttggagcatttgatcaaaaaaatggaacaagcgagtatgcaacttaattttgagcaggcagcttatttccgtgatcaaattcaggcgattcgtgcggtaattgaaaaacaatttgtttctaacgaacgtttagatgatatggatattctggcaattgcttatcagcttggtattgcttgtgtacaagttttatttattcgtcagggaaaagtattaggtaatcgcagttattttcccaaagtgccggcaaatacggatttaagtgaattaaccgaaacgtttgtcggacagttttatttacaggggcatcaaggtcggattataccaagtaccattattgttgatcatgttttgaatgaaaaacatgaacttgaggttttattaacagaacaagccggacgtaaagtaaatattcaagataatgtgaaaggcaataaaagcaaatttttacatttggctcaaatgaatgcacaagccgcattagtaacacagcttaaacaagctaatttaatacaagagcgttatcaggcattacaagaacttttgtctttaactaccattaaacgtatggaatgttttgatatcagtcatactatgggagagcaaacaatagcttcttgcgttgtttttgatactgaaggaccgttgaaatcagattatcgtcgttttaacataagcggaattactgcaggcgatgattatgccgctatggagcaggctttgttgaaacgttatgatcgcccattagaaaatgagaaaattccagatattatttttattgatgggggaaaggggcaattaaaccgtgctttacaagtttttgcacaattaaatgtatcttgggataaaaataaaccgctcttaattggagtagcaaaaggggtagatcgtaaagcaggtttagagacgttaattattagtaaacaaaataaggaagtgaatttattgcctgatagccttgcccttcatcttattcaacatattcgtgatgaaagtcattatcatgccattggcggtcatcgtaaaaaacgtcaacaggcttttactcaaagcggtctagaagccatcaaaggtgttggagcaaaacgaagacaagctttattaaaatatttagggggcatgcaaggtgtaaaaaatgcgactttagcagaaatttcctccgttccgggcatttctgctgcgttggcggaacggatttatgaaacgctaagaagtgaataagcagtaacaaagcaaaaggggaaaatatttaatttccccttgttttatctataaaatcagcaaaatcaaagaatgatgtttccattgtcatctgccggttttgttagcccgataataaattcaatgagtgcgataaaaccgggaatgaaagtccaacagaataaaagatataaaatacctaatcccgttttaccggcataaaatttatgaatacccaatccacccaagaaaaatgccagtaagcaataagcaattttatttaccggtttggctgtttgagcataggtgttttttgtttttaaaataacaggtgcttcatcagtaccgaatacatcgacttcatctctgacctgtggttcaaaatccaatgctgttcttggtacttctttgatagaaccatcaggcataccaatagaaactatgccattttcgatttttatgattttagccataacgttccctcttagtgttattagttttaattaattaaaatttttaaaagccaaggaagaaaaagctgaataagagaattttttcattggcttaaaagtgcggtttattgtactcaacctggaattagttagcaatatttccaataatgcttctcgtttcttctttaacgtctacaagttgaacatgaattatatcgccaattttgtatgttttttctcctttaatataaagtgcaatttcctcggcattgacctgaagttcttctctattgctgtgtaaggttgatgccggaataaagacggaagcaccattttccaatagaagtacacgtaatccgccacgcatgacatcttgtatttctgcttgaaatatttgtttttgttctactttatctgctaaatagcgacaatataaccaatctgcaatatctcgctcaactaaacggttttgacgacgagcctcttgtaaacgttgtaagacactatcttgagggcgttcatattgttgtgttgtgagacttgctttaattaggcgatgattaactatatccgaatatttacgaattggagatgtccatgtggcgtaaccttgcaaacctaagccaaagtgcggtgctaattccgttttaaattctgcagaggttaagaaacgacgtaaacgcaattcaagataattattttcgcttgctccaatatcatgacgcatattgcagtatccacttaaagttgctaaattttctacagaatagcgttgtttcaattctgcttgattttgttcgttggttaaatttgacagcaggaaatgatgtgcattttccaagaattttttatcgaaaccactatgagtattaaaaatcccaaaaccaattttttcatccagatattgtgccgcacaaatattcgcaataatcattgcttcttcaacaatttggtttgcaatgcgacgatattccgttttaatctcttgtactttaccattttctgccagtacaaaagagtagtccggtttttctttaaacagtaaagcatgagttttacgccattgtgatctggctaaggtaaactcatgtaaccacgcaatttgttgttgagtaacaggatcttgtggttgccaacaacctgttttttgttctaaataatcagacactttatcataagctagtttagctttcgacattacataagcagagacaaagtatggtgtggcggtaatttcaccttgtaaatctgttgtgatataacaaaccaatgcggcacgttgagcattttcggaaagagagcaaagatcgtcggataactctcgaggcaacattggaatattaaatcccggcaagtaattagtgaaacaacgttgtttagcatcttgttcaatttgtgaattaatatcaatataagctgttggatcggcaatcgcaacgactaatttccaaccgacttgagcttcattttcgctaattggctcaatatataaagcatcatctatatcttttgttgtttcactatcaatagtgatgaagtgaagtgcggtgagatcttcacgttcttgttgatccaatagagggtaactttcttgcccttgcacgggataacgagattgttcatgatatgccaaagttacccaccaaggtgcaagttcgtcatcagcgtgacaaataaattcagaaatgtgtgcaaagaaaaaacgatcatcacgtaaaggatggttttttagctgtgccacaacccaatctccctcttgtaattcttctttaacggcttttgtttgtgtcgctccaattggctgattaatttgggggtgatcgactacaagttgtaatttcttgtctttattgaaccgcactttggcaataaagcgagttagcatggggtcaatgagttcttccggttcagcttgttctttatcgccaatcgtttcaatcactgctttaattttgtcgccatgcataacttttttcattgccattggcggaataaaataactttttttatcacactcaaggaaaccgaaggctttgtcagaacctcttacaataccttctacatgcggtttactatcacgaatttgttgtttgagttgggaaagtaggggattattttgaaacatattcttacgctataaatgaaaacggatgttcagttgaacatccctagaaaagattaaatgtagattattctgcacataagtcgcccatggcagtaatgctaaaaccggcatcaacatgcaatacttcacctgttatacctgaagccaattctgagcataagaatgcggctgaattgcctacatcttcaatagttacggtacgacgtagaggggctgtgttttcaaaagtggccagcattttcttgaagtttttaatgcctgatgccgctaaagtgcggattggaccggctgaaatagcattgacacgaataccgtctttacctaagtctgccgccataacacgagttgccgcttcaagagaggctttcgctaaacacatcacattatagtttggaatggcacgttcagcacctaaataagtcaacgttaataagccggcgttttgatttaacattggacgggctgcttgtgccattgcaacgaaactgtatgcactaatatcatgtgcaatgcgatagccttcacgagttgccgcattgacatagtcgccgtcaagctgatcgcccggagcaaaagcgatagcatgcacaaaaccatcaaacttgtcccaatgctgttttaattgtgaaaaacatgccttgatgctttcatctgttgcaacatccaaaggtaaaacaatagtagaaccaaattcttgggcaaattcttctacgcgtgcttttaatttatcgtttaaataagtgaacgctaattcagctccttcacgtttcattgccgttgcaataccataagcaatagaacggttgctcgccaaaccagtgattaaaatgcgtttacctgctaaaaatcccataataaaaccctttattcggttagttaaaaagtcggcatagtataagtcaaaatgagagaaaaaacaaaagacgcaagagtacgctgatctttaagctggattatcaatatctttaaattcaacttcaaaaccgtattcttgagctagccattcgcctaaggccttaataccataacgctccgttgcgtgatgaccggcggcaaaaaaatgaatgccttgttctctggctgaatggatcgtttgttccgatacttcgccggtaataaaagcatctaatccttttgttgcagccaaatcaatataaccttgcccaccgccggtacaaataccgacagttcggattaagtgcggtgcattttcaccacaaaataaaggtttacgccctaatgctttttcaatgcgttgagccaattcttcaccgcttaccgtctcaactaaatcaccataaacaggaatactgaaactaccattttctaatgggcgtaaattttcaatacctaataacttcgcaagttgtgtattgttacccaactctgcgtgtgtatctaacggtagatgatacccatacatattgatgtcattttgcaacaaggttttaatgcgtttacctttcatccctcggatgcaaggattttcatttttccagaaatagccatgatgaaccaaaattgcatcagcttgttgtgcaacggcataatcaattaacgcttggcttgcggttacaccggtaataattttttgcacattggattttccttcaatttgtaaaccgttgggtgcataatcggagatattggcactattgagtttttggttgataagttgctccagttcaagattattcatattgttatccatccaattaaattttatttaatttcagttccttttaataacttacgtatccaactgcgatttgggctgagattatgtagaatatcttcgctcaaagggagtggttctgcataaatcagagaggcaagggtttcacctaataaagcggctgaagttaaccctcttgaacctaacgcaccgatgagatataaatttttccattgtgctgcatcaggaataggctgtttacgacgacgtaaattgaagatgtttcggtagtctaaacattgttgctcaaaatgaggtacattccccataatcggcacacgatcacgcactgaacaacgaacacctattctagctatattggctgatatatcaatatcctgcaaccaatccatatttttatccgtatcggtagaagctagattttgttgaattttttgctgattttcccgttgttcttgatggctaaaatggcgatctttgttattgcgaatatgacttgcaccaaggcaatgactctgtttcattttatccgccggagttaaatagccatcgtaacaaagtacggacttaagtttcagtaaatttgcactggtcggaatttggctgacttgacctcgtacgggataaagaggaagtttagctgtttgcacaaaatctgtaatttgataaccattggcgagtacaacaacttgatgattaaaggtttcattttgttcattggttaaaacccattgtaaatttcggtagtcaagtgcggtaattttttgtgaggttttgatctctaatccaagttgttgtaagtaagagaaagtattttgcacaaattgacgtggagcaagccaacctccctgcggaataaaacctcctgcacaatctaaaggaagccctattttttcacttaactgctctttatttaaattctgatacaagctttttgaccattgataagaagaaatttttgccaatttaaccgcacttttgtgatcgtaagcacaaagtgctacaccacaaaattcatgttcaaattctataccttgtttaattgcccactgcaattgttgtaaagcatagaaaaaggcatgaacataaaaacgaatgttgcgatcatcgtcatcacttaattggggataaaaagcaccttgtttgttaccggaggcattgagggcaagttgctcatcttcacaataaagagtgatttttgcccccctttttaatagtgaaagtgcggtgaaaagtgaagcgattccgcctccgataattgcaatgtcttcagaaagtaatgaggcgggctgacttaagtaccaaggggcttttgtattttgttgtggaatagcatttttaataccacataaacattcccgctttttgccgtaaccttttcgtttttgtacttcgaatccggcagaaactaatccttttctgaccgcacttgcagcggtaaatgtggaaaatgttccttgtggcttgctgtaatagaacatctgttgatagagttcatcattccacatttgtggatttttactgggtgagaaaccatctaaaaaccaagcatcaatacgattttgcatataatcacccagttggggcaaattatcgacaatatcaccaaaccataaatccaatgttgtttcagcaaaatgaaaacgttgacaaccttgtatcgcctctaagcaataatcgcataattgttgtgataaagcagaaaattgtgggtaaaattgatgaatttgttgtagttgaactttgggaagagggtatttctcaaaggaaataaaaaataaatgtttaagtggggaatgagaatattgttgccgaaattggcgaaataaacttgttacggcaagaaaatttaaacctgtaccaaatcctgtttctgcaatgacaaaatgtttttcttgatagacaatccagcgttcccataaatgattaccttgctgaaatacgtattcgctttctgctaaaccgtcttggttggaaaaataaacgtcattaaattgttctgataccggtgttttttcttgattcaggtaaattttggcgggtgtaactgtaaacataatatagctaatttttttgttgcattcatgatttttgctataatagcgaaaattttttcactggtcgaacattcgaagaaagacttgaaatattttcattttatagtaagttggcgaccgattattttattctttaacgtaaaggaatgtttctatgagaagagccgtggttacaggttttggtattatttctagtattggtaataataaacaagaagtgttagaagctttaaaaaaagggaaatcaggtattgaagtgatgccggattttgtcaagatgggcatgcgtagtcatatagcgggaacaattaaattaaaccctgctgaattaattgaacgcaaaattttccgttttatgggagatgctgctgcttatgcttatctctcaatgaaagaggccatcgaagatgctggattgacggaagatcaagtttccaatgatcgtaccggacttgtcatcggagcgggaacaggatccggtcataaccaaatggttgcttgtgatgctgtaagaggtccaagaggcgttaaagctattggaccttatgcagtaactaaaacgatggcatctagtgtatcggcttgcttagcaacaccttataaaatccgtggcgtgaattattcgattagttctgcttgtgctacttctgcacattgtattggacatgccgtagaattaattcaattaggtaagcaggatgtggtttttgccggtggagcggaagaattatcttgggaatgtgcaactgaatttgatgcaatgggagcggtttcaactaaatacaatgaaacgcctgagaaagcttcacgtgcttatgacgctcatcgtgacggatttgtgattgccggtggcggtgcggtagtcgttgttgaagaattagaacatgctttagctcgtggagctaaaatttatgcggaaatcgttggctatggtgctacatctgatggatacgatatggttgcaccgagtggtgaaggtgcggagcgttgtatgaagcaagcattggcaacagtggatacgccagtggattatattaatgtgcatggtacgtctacacctgtcggagatgtaaaagagttaggtgcaattcgcaacgtatttgctgatcaaaaacctgccatttcttctacgaagtcaatgacggggcattcactaggtgcggcgggtgctcatgaagcgatttatagcttattaatgttagaacatgattttattgcacccagcattaatattgaaactttagatgaacaggcggtcggtatgaatattgtgactgaaacaaaagagaatgcgggactcgaaaccgtgatgtcgaatagttttggttttggtggaaccaatgcctgcttggttttcaagcgttataaaaaatagagataattcttttatagtgatctatctaatgatttagacagatactgttcttttagaccttattttaaaggactattttagatattgaagtgagctgcctctaaaagttggacggaataaccaactgattagaggcagatttttatgattaaatgcaaaacaacaaactactgagtagtctttttatatttttagaatttgttttatattaaaattctctctttatctttaaataaaaatttaataaatatcaagtttaatgaatataatttttaataattgttattttgataaatttaatttaatgatattatcttaatgctttaatatggaaggttaaatcctgaaaagcaaggtactgaatacgatgttgctattaagcgaacttttatacgcatgaaacaggtcgtggcgtcttttgattttttattttattgatgtggttattatgaaaaaatttattttactcggattattactttctttttcttcatcaagcattgctgagttatctgattggattaagccgatttcggatatctcctccggagatactgcatgggtaatgatatctgcaatcttggttttatttatgactatccccggtttggcattattttatgggggaatggttcggaaaaagaatgtgctgtcgacaatggcacaaagttttgcggtaagcggtttgatagccgttatttggttgtgtttcggttatagtctttcatttacaccaaataatgcttttattggcggaatggatcgtttttttctgcaaggtttaaatgtgtttactgaacagaaaatgcttactgtttatccgggagctggaacgattccggaatctgtttttatgatttttcaaatgacctttgccattattgctggagcgatcattacaggtgcgactgtagagcgtatgaaattttcggcattattgttatttgttggattatggtcacttttgatttatgttcctaccgcacattgggtatggggaataggtggttggctagtaaatgatggggtattggattatgccggtggtaccgttattcatattaatgcaggtgtagcaggattagtcgctgcaattgtcattggtaaacgggtcggttacagacatgaagtgatgatgccgcacaatttagtattaactctaataggtacggcaatgttgcagattggttggtttgggtttaatgcgggttcggcacttgctgctgatgcaagagcgggtatggcattggcaactactcagatttcagcctcggtcggagcattaacttggatattagtcgaagtattttgtaaacacaagccgtctgcgttgggtttggcatcaggagcggtagcagggttggttggtattacgcccgctgctggttttgtatcggtacaaagtgctttattcataggtatgataacaagtgcggtctgttttgtcggtgtaatgaagctcaaatattggtttcgatacgatgatacgctcgatgcgtttggtattcacggtttaggcgggattgttggagcggtgttgacaggcatattcgtatctcctgatatttcagctactgaaactacactttggacacaaattgagagtgttctaattactatcatttttagtgcatcaggtagttttgttttattaaaaataattgacaaaaccgtagggttacgagtggagcgagatgaagaacgtcaaggtttggatttaagttgccatggtgaaagaatagaatagttaaaaaatgaccgcactttacgctttataaagtgcggtcagattatagtaactatataatttgaagatgaaattcgaacacctattatttggtgttaattaaataatttttccctccagtatccaaattcttttaacaattgtgagtttatattcaaagaaattgcttgtatttgtacttaaatcgtgaagttagtcgttgatggttgtagaaaaaataaaagttacattctaaaagaagatccaaaatttaaacacgtgatagatagttttgaatggacagcttagcctgtgggtaggggcttgtcaccgttctctgttttttgctatcaacctattttcaggtaaatacagagaacccttctcgactagtttggatttactgagtaatcaataagggtatatgcctgaaaaaatggttcatttcttaattgttagcatactattatcaagctgcatgagtactgccataaaattttaggataatttaggataataatggggtaactctctcaaaaagaagctaaaatttttgatcaatgccaagagggggtaatcaattaaaaagtaataacagatttaaccattaacttttaatttacggagatatatgatgaacagcgtgaacaactcaattttttaacgaactaacccattcgtcaaatgtaatatcactcaaattaagaattttgaaaaagatttttcaatcaaaagccctgaagattatagaaattatttatgctatttaataatagcggagctagtgttcatcatatgtatggattgcataattatgagacatgtagattttgaatggaaaaaggcatattggagtatgaacagggaactttatatcggttattatgatttggagcgggaaacgaggctcgaactcgcgaccccgaccttggcaaggtcgtgctctaccaactgagctattcccgcttattcctgaagaacggagcgtattatacaaatattttactaagaagcaaggttaaaatttaaaaaaatgcaaccttgcttgattattggttgaattaattatttgtttgttaagttaataaaggtattcctataatgagctaattcagcaatggattcacgaatatcatctaacgccaaatgtgaattctttttttcaaagctatttagaatttcaggtttccatcttgatgcgagttcttttagtgtgcttacatctaaatgacgatagtgaaagtattcagctaattcaggcatgtagttgattaaaaaacgtttgtcttgagcaacgctatttccacaaataggagaaacacctttaggaacccatttttttagaaaatccaaggtttgtaattctgcagcccgttctgttaatttgctgttttttacccgttcgattaagccgttagatgtatgagttttcacgcaccattcattcatgttattgagaagttcgtttgattgatgaatggctaaaacaggaccttcagctaaaatattgagatctttatctgttacaattgttgcgatttcaataatccgttctttatcaggatctaagcctgtcatttccaagtcaatccaaataagattttgtttatctaattgcataataagagtatcctatacaagatttcttatattctaactgaaaaatgaccgcactttaaggatttctctttgagcaaacgtaaattaacccaaaatcaacaacgtcgaattcaatctaataatgcaaaaacattacatcgtcatcaacatcggcacaaatcagatattgattggcaagatgatatgcttggtgattttcaagatggaacggttgtgacaagatatgctgttcatgcagatgtagaaaatgagcaaggtgaaattattcgttgtaatttacgccgcacattgaaaagtgtcgttgtgggcgatcgtgtcgtttggcgtaaaggaaaggaacaactgcaaggtgtaagaggtgtcattgaagctgttcaaccacgacataatcagattgtacgcccggattattatgatggtttaaagccgattgcggctaatattgatcgtattattattgtttcagcggtattaccaaatttatctctcaatattattgatcgttatttagttgtttgtgaaagctcgaatattccagccgttattgttgtaaataaagcagatttattgagtagtgaagctcgaatagaagttggcttacaactcgaaatttatcggaaaatagggtatgaaacgttattaatctctgccaagagcggtgagaatatggagaaactgaccgcacttttgtctgaggggacgtctatttttgttgggcaatcaggtgtgggtaaatcaagtttaattaattatattttgcctgaagtgaatgcacaaactggtaagctcagtcaagtatctggtctaggtcagcataccacaacatcttctcgcctatatcacttatcacaaggaggaaatttgatagattctcccggtattagagagtttggtttatggcatttagatcgagagcaaatcacgaacggttaccgagaatttcagtattttttgggaacttgtaagtttcgagactgtaaacatttgcatgatccggggtgtgctattcagcttgcagtgaaagaaggaaaaatcgatcctttacgttttgaaaattatcatagactaattacaagtttgtccgaaactaaatctcaacggcattttatatcggcgaattaagttaaagaagatattttgtatacttaataaacaacttggagctttttttgtgatgtagttcaaattttaatgtggtttaccttgattattctgatttgaaacttgatactatgcctctgatttatttttttatttaaaataaatatgaactgacactaacgaattgtttttgaagcgttaggatactacatgtagaatgatttaaattaagaggatacagttatgtactcaaaagatgttgaaattactgcaccaaatggtttacacactcgtccagctgcacagtttgtaaaagaagccaaagcgtttgtttctgatattacagtaacttcagcgggcaaaagtgctagtgcaaagagtctatttaagttacaaaccttgggattgactcaaggtacagttattacgatttctgctgatggtgaagatgaacaaaaagcggttgaacacttagttgcattaattcctactctagaataatcaatatatttattagccataacttaatgttttcataaataataagtttatggctattgtgttatttagcgtattgtaatttaaaattattttggaaggttaatatgatttcaggtattacagcatcaccaggtattgtatttggtaaggcactggtgcttaaagaagaaaagattgttcttgatacgcaaaaaataaaagatgagcaaatagacattgaagttgctcgtttttatagcgggcgtacggcagctatagagcaattgattgcgattaaagatcgtgctttagtctctttaggtgaggaaaaagctgcaatttttgaaggacatttaatgatccttgaagatgaagaactggaagaagaaattttagattacttacgttcaaataaggtcaatgcaggcgttgctgcaagtaagattattgatcaacaagttgctatgttgtctgaaattgacgatgaatacctacaagagcgtgccggagacattcgtgatattggtaatcgtttgattaaaaatattttaggtatgaaaatcgttgatttaggggatattaatgaagaggcgattttggttgcttatgatttaaccccttctgaaacagcacaattaaatttggataaagtattaggcttcattacagacattggtgggcgaacatcacatacttctattatggctcgttctcttgaattgccggctattgtaggaaccaatgatatcacttcaaaagtcaataccggtgattatctcgttcttgatgcggttaataatgcgatttatgttaatccgacacaagaagaaattgagcgtttgaaagctttagagcgacaattagccgaagaaaaagcggaattagctaaattgaaagatttgccagcattgactttagacggacatcaagtagatgtggtagctaatattggcactattcgtgattgtgagggagctgatcgtaatggtgctgaaggcgtcggattatatcggacagaattcttatttatggatcgtgatcagttaccaacggaagaagaacaatttattgcttataaagaagttgttgaagcaatgaatggtcgtttagttgtgttacgcacaatggatattggtggagataaagatttaccgtatttgaatttacctaaagaaatgaatcctttcttaggttggcgtgcgattcgaattggtatggatcgtcgtgaaattttacatgctcaattacgtgcagtattgcgtgcgtcagcttttggtaaattagctgttatgttcccgatgattatttctgttgaagaaattcgagaattgaaatctgtgattgaaagtttgaaacaagaattacgtgatgagggtaaggcttttgatgagaatcttcaagttggggtaatggttgaaacaccggcggcagcaataaatgcaaaatttttagcaaaagaagtcgatttttttagtatcgggacgaatgatttaacccaatatactttagcggttgatcgtgggaatgaattaatttcacatttatacaatccgatgacaccggctgtattaaacttaattaagcacgtgatagatgcatctcatgaggaaggtaaatggactggaatgtgcggtgagttagcaggcgatgaaaatgccacattgttattgttaggtatgggattagatgaatttagtatgagtgcaatttcgatacctcgtattaaaaaattgattcgcaatgtgaattatcaggatgctaaattacttgctgagcaagcattacagcaaccaactgcggcaggtattttgagcttagttaatgattttttagtggaaaaagcacttaattaatatcatttgataaaaaattacgctagaatagtgcaattattcatgagtaggagaaagtttaaatggctttttttgataaattatttggttcaaaggaaagcaaatctattgatgttgaaatttatgcacctatatcaggtacaattgtaaatattgaggatgtaccggatgtggttttctctgagaaaatagtaggtgatggcatagcaattcgtcctacggggaataagattgttgcacctgtagatggagtaatcggtagaatatttgaaactaaccatgcattttcaatagagtccaaagatggcgtcgagttatttgttcactttggtattgatacagtagaattgaaaggtgaaggttttactcgtattgttcaggaaggtcaacaagtaaaacgtggtgaaacaattattgaatttgatttggcttcattggaagcaaaggcaaaatcagtattaactccgctggtaatttcaaatatggatgaaattaatagtatggataaaatgtttggcgaggttgtggctggcgaatcagttgtgctcttgttgaaaaaataatgaatagtgttatttaaaacggattggtagtggctaatccgtttttttatatcaataaatttttaaggaagaacagcatgtgttttttctattttcatataaaaactactatctttatttcaaaaaatctaataacatttacgaaatttgttaagatttgtggcgtaaactagatttgattagtttcgttgtgagttttgctaacattatcagaattttagttatcaatccgttgtttaatttagtgttataaattaaacgtaccttttaacttaacacaataaggaaaagactatgtcagatatattgaaaaatgacgtagatccggtcgaaaccaatgattggttattagcgatcgattcagtaattcgtgaagaaggtattgagcgtgctcaatatattatagaacaattgatgcaacatgcccgtgcaaattctgtgtcattaccaacgggtgtaagcacagattacattaacacaattcctccatcagaagagcctaattaccctggtaatttagacttggagcgtcgtattcgtagtgcaattcgttggaattcgataatgatggtattgcgtgcttcgaaaaaagatttggatttaggtggacatatgtcttcttttcaatcttcagcaactatttatgaagtttgttttaaccatttctttaaagctcgtacagaaaaaaatggtggtgatttagtttttttccaaggtcatatttctccgggaatttatgcccgtgcattcttagaaggtcgtgtaacagaagagcaattagataatttccgtcaagaagttgaaggcaaggggttaccttcttatccacaccctaaattaatgcctgaattctggcaatttccaactgtatcaatgggacttggaccattgaatgcaatctatcaggcacgtttcttaaaatatttacataatcgtggcttgaaagacacttcagagcaaactgtttatgcgtttttgggcgatggtgagatggatgaagtagaatctcgtggtgcaattgcgtttgctgctcgtgagaaattagataacttagtttttgttatcaactgtaacttacaacgtttagacggtccggtaaccggtaacggtaaaatcattcaagaacttgaagctcaattcaatggttctggttgggaagttattaaagttatttggggacgccgttgggatcgtttattacaacgtgatacatcaggtaaattattacaattaatgatggaagttgttgatggcgattatcaaactttcaaatctaaagatggtgcttatgttcgtaaacacttctttggtcgttatcctgaaacagaagcattagttgcggaaatgacagacgatgaaatttttgcacttaatcgtggtggacatgatccattaaaagtgtttgcagcatttaataaagcaaaacaagttaaagataaaccggttgtattattggttaaaacgatcaaaggttatggcatgggagaagcagccgaaggtcgtaatatagctcatcaagtgaaaaaaatggatatgtcaggcgttaagcatgtacgagatcgtttcaatgttccggtatctgatgcagaaattgataacttaccttatgttaaatttgcagaaggaacagaagaatataaatatcttcatgaacgtcgtcaagcattgaacggttatttaccgactcgtttacctcgctttacacaacaaatggatgttcctgcattagaagaatttgcacaattatttgaagaacaaagtcgtcctatttccactacaatggcatttgttcgttcattgaatgtattactgaaaaataaatctgtaggtaaacatattgttccgattattgctgatgaagcccgcacttttggtatggaaggtttgttccgtcaaatcggtatttataacccacatggacaaaattatactccgcaagatcgtgaacaggtatcttactatcgtgaagcaattgatggacaagtattgcaagaaggtatcaatgaacaaggtgcaacagcatcttggttggctgcagcaacgtcatattcaacaaatgatatgccaatgattccattctttgtgtattattctatttttggtttccaacgtgtaggtgatttaatgtggttagcaggcgatcaacgtgctcgtgggttcatgattggtggtacttcgggacgtacaaccttaaatggtgagggattacaacatgaagatggtcatagccatattcaatcttctgttgttccaaattgtatttcttatgatccggcttttgcttacgaagttgctgttattatacaagatggcgtgcgtcgtatgtatgggcctgaacaagaagatgtgtattactatatcaccacactgaatgaaacttatgatcaacctgcaatgcctaaaggtgcagaagaaggtattcgtaaaggtatctataaatttgaaacagtaactggtcaaggcaaaggtaaggttcagttattaggttcagggtcaattttacgtcatgttcgtgaagcggctaaattacttgctgacgatttcggcgttacatctgatgtgtacagtgttacttcatttactgaacttgctcgtgatggtgcgaatgcggatcgttggaacttattacatccaaaagcagaagctaaagtaccttatattgctcaagtaatgaatgatgctccggcaattgcttcaacagattatgttaaactatttgcagaacaggttcgtccatatatacctgcacaaagttatcgtgtattaggtactgatggttttggtcgttcagatagtcgtgaaaatttacgtaaacatttcgaagtaaatgcacattatgttgttattgctgcgttaaccgagttggcacagcagggtactatcagcaaagatgtagttgctcaagcaattagtaaatatggtattgatgcagataaaatcaatcctttatatgcataatcaatatttgaactgagcggatataatccgctcgtaagaaaaggataagataaaatggctaaagaaattcaaattccagatattggtggagatgaagttactgtcactgaagttatggttaaagctggggatactattatagttgatcaatctgtgattaacgttgaaggcgataaggcatcaatggaagttccatcaccggaagcgggtgtcattaaggaagtattagtaaaagtaggcgacaaagtttctactggaactcctatgtttgtattagagaatgcagaattagcatctactgagacagcatctgaaagtatgcaaaccgaaaaaacacaaagtgcggtagcgtctatcattgaaatttatgtacctgacattggtggtgatgaagtcaatgtaactgatattatggtttctgtaggtgagacagttgcagaagagcagtctattttaaatgttgagggtgataaagcctcaatggaagtgcctgcccctactgccggtatagtaaaagaaattttaatcaaagtgggagataaagtgtcgaccggttctcttgtgatgaaatttgaagttgcaggtgttgtatctgtagccgaaacagctcaagtttcttcttcagctcaagtaacaggtgaaagtgcggtgcaagatgtacacgttcctgatatcggtggtgatgaagtcaatgtgacagaaattatggttgcagtgggcgatagtgttacagaggaacaatctttaattactgttgaaggtgataaagcttcaatggaagtgcctgctccttttgctggtgtagtgaaagaaattttggtgaaatcaggggataaagtttcaactggttcattaattatgcgttttgaagtgcaaggaaaagcccctactccaaaagcatcatcggctgtgacagaggctaaagtggctccatctccagctgcacaagaaaatcaaatgacgccagtgtctcaagctgatgtgactgcaagtgcggtgtttgctcatgcaactccggttgttcgtcgtctagctagagagttcggcgtgaacttagacaaggtaaaagggacggggcgtaaaggtcgaatcttaaaagaagacgttcaggcttatgtaaaagcggcaattaaagcggttgaaagtggcaatgtttctcctacatcagcaggtaatggtgctgtcaatggagcaggactaggcttgttaccttggccgaaagtcgacttcagtaaatttggtgatattgagcaagttgagttgggtcgtattcagaaaatctccggtgcaaatttacatcgcaactgggtaatgattcctcatgttacgcaatgggataaagcagacattacggaactggaaaaattccgcaaagaacaaaatgtgttggcggaaaaacaaaaacttgatgtaaaaattacgccattagtatttattatgaaggccgttgctaaagcgttagaaaattacccacgctttaatagttcattatcagaagatgctcaaagcctgattctgaaaaaatacattaatattggagtggcggttgatacacctaacggcttggttgtacctgtgtttaaagatgtgaataaaaaaggcattattgaattatctcgtgaattagcggaaatttctaagaaggctcgagctggtaaattaaccgcatcagatatgcaaggtggttgttttactatttcaagtctaggaggaattggcggtacacactttacgccaattgtaaatgctccagaagtcgcaattttgggtgtatctaaatctgaaatgacaccggtatggaatggcaaagactttactcctcgcttaatgcttccgttatctttgtcttatgatcatcgtgtaattgacggtgctgatggagcaagatttattactttcattaatagtgtattaagcgatcttcgtcgtttagttatgtaaatactacgcctctaaatcttattagggggcgttaaaactgttaaagtgcggttgaaaaccgccaacttttaacgaggtaaaaaatgaataaagagattaaaacacaagttgtcgtcttgggagcaggtccggctggttactcagcagctttccgttgtgcagatttaggcttagaaactgttattgtagagcgattttcgacgcttggtggagtatgtttaaatgtaggctgtattccgtctaaagcgttattgcatgtagctaaagtgattgaagaagctaggtccttatccgctcatggtattgtttttggtgaaccaacaacggatattgataaaattcgtggttggaaagaaaaagtaattaatcaattgactagcggtttagccggtatggctaaacagcgtaaagtacaggtagttaatggttatggtaaattctcaggaccaaatgcaattattgtggctggtgatgaaggtgaaacgaaaattacttttgataatgcaattattgctgccggctctcgccctattcagttaccatttattccacatgaagatcctcgtatttgggattctactgatgcgttaaagttaaaagaagtacctgaaaatctcttaattatggggggcggtatcatcggtcttgaaatgggaaccgtttatcatgctttaggttctaaaattgatgtggttgaaatgtttgatcaagttatccctgcagcggataaagatatggttcaaatttatactaaacgcattgaaaaaaaattcaatttattactggaaactaaagtaactgctgttgaagcaaaagaagacggtatttatgtatcaatggaaggtaaggctgcaagtgaaactcgtcgttatgatgcagtattagttgcaattggtcgtgtaccaaatggtaaattaattgatgcaggtattgctggcgtcgaagttgatgatcgtggctttattcgcactgacaaacaaatgcgtactaatgtacctcatatctttgctattggtgatgttgttggtcagccaatgctagcacataaaggcgtacatgaaggtcatgtagctgcagaagtaattgcaggacaaaaacattattttgatccgaaagttattccatctattgcttataccgaaccggaagtagcttgggtggggaaaactgaaaaagaatgtaaagctgaagggattaattacgaagttgctaagttcccttgggcagcgtctggacgtgcaattgcatccgactgtgctgatggtatgacgaaattgattttcgataaagatacacatcgtgttattgggggagcaattgtcggtactaacggtggtgaattgctaggtgaaattggcttggcaattgaaatggggtgtgatgctgaagatttagcactaacaatccatgctcatccaactttacatgaatctgttgggctagccgctgaagtttttgaaggctctattacagatttgccaaatccaaaagcgaagaagaaaaaataataatcttgctcgatgagacaataaggcgatcttttctgagatcgccttatttttttgcaaaaaagtgcggtaaaaaatacggcactttttaggcggcaaattttatttgattttcttttggttttatttgatggattgtattggttactgtaccaataataggcaaattttgccaattagatgttcttattgaatgtactttattatctagtgggaaaaaaataaattcattattttcatgcatcatgaattcataaatttgaaattggttattaagatctaaaacgacaagatcattcattgaaaggtaattttgtttttctacaataagaatatcaccttgctcaatattccaagcgagcagattaggattgttaacttgaataaaacaagtttgttgtgggtgtttaatacagtaaagattgagatctagttttttgtgtgaacttctattacgttcctcaatatcaatgaagaatggcataggttggtaagaaagtgtagtgtttatattgctgatattctgatttgcgtaacccatctttttctccaatctaagtatgttatatattaactgattatttatacaggtatatattactgtttttatatacatatagtcaatagcataatagaaatttttagaaatttgcagattaataaatgtattttattttataaaaattcaaaaaatgtttattttaatattttctttataatcaatttacgttatctttactaaaccttggtggatctatagatctgtatttttaactcaaaaaacacaacatttattattatgaataagtcatatttatactccttcttttttcatggaagtttggtcaagcgaatttctgttggtcttttattgggattgctgttagcattaatcgctccatcattgcaaggtgtattaggttttaatcttgcagaaaaagccggttttttaggaaaaatatttgtgcgttcattgcgtgcagttgctccaattttagtttttttattggttatttctgcaattgctaataagcaattaggcacaaaaagcaatatgaaatctattgttgtcttatatttgctaggaactttcttagctgcattgacatcagtattatttagttttgcattgccgacagaaattgctttaaaaacgcaagaaggctctctttctccgccaaacgaagtatctgaagttttaagtactttagtactgaacgtggtagataatccaattaatgctttatttaatgcaaactttattggtatcttattttgggcaataggtttggggatagccttacgctatgcgtcagatacgactaaaaatgtcatgaatgatttttcagaggctgtatctagaattgttcattttattattagttttgcacctatcggtgtttttggtttggtagctgaaactttaactgataaaggtttgggtgcattgcttgattatatgcaattactagttgttttaattgggtctatgctatttactgcgtttgttattaatccaattttagttttttggaaaattcgtcgtaatccatatcccctagtatggacttgtgtacgagaaagtggattaacggcattccttacacgtagttctgcagcaaacattcctgtaaatatggaattgtcaaaacgcttaaaattagatgaggaaacttattcagtttcaataccgttaggtgctaatatcaatatggcaggtgcggcgattactattacggtattaacattagctgctgtacataccttaggtattgaggtctctttccctacggctgtattgttaagtgtagtggctagtatttgtgcttgtggtgcttctggtgttgctggcggatcattattattgattccattagcttgtagtttatttggtattcctaatgatattgcagcacaagtaatcggcgtcggtttcgtcattggcgtattacaagattcaacggaaactgcattaaactcttcaacggatgttatttttacagctgcggtatgttggagtgaagaaaataaaaattcatagagtttatctaatgtgaaatatagcgggtatgggtacatatccgctttttcgttatacttgatagccttctgcatgaagtgataaagtagaaaaaatttcatctacgatgagaatgctttagcatcactgtactttttgctttgaaatggagatatccctctcataaaaacactatagttttcataagaataagttattttcaaaatatactaataatccatatggttattaatttttacaaaaactttctgttcaataatttaaaaaagaggaatataataggatacactagtttaatagtcaggagagaaatatgtatatcagtcggaatatggaacaatggaatgaatttcttgatttaatgagaaaagcatttgaacaaggcaaagaacaagaactacttactttgctacttactgctgatgagcgagatgcagttgcactacgcgttcaaattgtatcccaattactggataaatctttggcacaacgagagatacaacaaattttgaatacaagtgcggcaacaattaccagaggttcaaatatgattaaaattatgcctcctgaatttatggactgggttaaacagcaactaaaccataacaataaaaacgaattaggtggtgactaataaaagggtagtaagagtgagaccttaagtcatttttgtttactattttcctatacaaatgcacttctaaacagaaaacagtctttactataaaaaatttacgtcaaaaaaatctgacagtttcatacttaaagagaacactgtcagatttaatttactgtatagtatgatgattatgcgttattaccagtgattttagccacttccgctgcaaaatcttcttcaactttttcaataccttcaccaacttctaaacgaataaagtttgttactgaagtattaactgattttaagtaatcaccgacagaaactgaaggatccataacgaatgcttgaccggttaaagacacttcaccagtgaatttcttcatacgaccttcaaccattttttcagcgatttcttttggtttgcctgagttgattgcaatatcaatttgaatttgacgctcatgttctacaacttcagcggaaacatcttctggatttacgaattcaggtttagaagctgcaacgtgcattgctacttttcttaattcttcttctgaaccggatcccgctactaacacaccaatttttgcaccatgtaagtattgagcaattacatcaccctctaaatactgaacacgacgaatcgtcatattttcaccaattttagcaactaacgcagcacgtttatcttcaaaatgagttgctaaggtatcaatcgttgttcctttgtttgccaaagcgtaatcagcaacttcatcagctaaacctaagaagccggtatcttttgctacaaagtctgtttcacagttcagttcaactagaacaccaaaaccggaaccaatgcgtacacgaataacaccttcagcagctatacgacctgctttttttgcagcttttgcctgtcccgatttacgcatattgtcgatagccagctcaatatcaccatttgcttcaactaatgcttttttacactccatcatacctgcaccggtacgttcacgaagttctttaactaatgctgctgtaatttcagccatcttaaattcctctatccatttgattaaatagtatcggttttagaccgcactttattgatataaaaagcagggaactaaaagccccctgcgtttaattaataagggcttacgcctttactgaattattctgctgctgcaaaaacttcttcagttaccgtttcttgattacgaccttcttttactgctgtggtagctgcagaaagatataattgaattgcacgtgacgcatcatcgttacctggaataacaaaatctacgccatctgggcttgagttagtatcaacaattgcaaatacagggattcctagattatttgcttctttgattgcgatatgttcatgatctgcaccgatcacaaaaattgcatcaggaagaccgcccatatctttgataccgccaagacttaattcaagtttttccatctcacgagtacgtactaacgcttcttttttcgttaatttatcaaaagtaccatcttgagattgggtttctaaatcttttaaacgtttgattgattgacgcactgttttccagtttgtcaacatcccgcctaaccaacggtgatttacataatattgctgacagtctaacgctgctgctttaacaacttcagaagctgcacgttttgtaccaacaaataaaattctgccgttattactcgcaatacgagttaattcaactaacgcttcattgaacattgggacagttttttctaagttgatgatgtgaacaccattgcgaggtccgaaaatgaacggtttcatttttgggttccagtaacgagtttggtgaccgaagtgaacgccagcttgcagcatatcacgcattgaaacttgtgccataagataattttccttttgtttggggtttagcctccacatatcaagcaaatcgaccgtttggcaccccgatttacttctcatgatacgtgtgtgatttcgtaagttaattgttaaattgacaactcaaaataacgtcgcactttataccacaaagtgcggttaaaaactagaagaaactcttaaattttgcaaaaaaataatgcctgataacctcaggcactatttttgcaattcgaagaaatgtaaccctgcttttactcttcattaatgaattttgtattaatttcaatactggctttttctcttaaggcttgaataagcaaattgcttaaactaaattgcttaatttttgctatttgaacgccaaataattgtttttgctcaggcgttaattggctatcttctacgttcattaactcaacaaaaacaatatctccaaacatatttttcgctacagatatggttgttttgcccgggtcaggttttttcattgagaatatcactttgcctaaaacaggatctttattatctacatctctataaacccacgtttctttttctgaaaaatgaatataagacggtaatttgaaatcagtcattgtattcatctctgcaacgattttctctgccatattaaacaacgtagtttcggctttctgacgttttaaataagtttcaatatctgctgttgcctcagccagtgtacgaataccctcaggtttataatcaactacacgcagaagcacggaatgttgatcgccaacattgattgcctctgagtttataccgccttgcataagatcagaattaaaaatggcggtagcaatatgactataatttaattctggcggtaaatcttgacgagaaaaataatctgtttctttgatttcaagcccagctactttagctgcttcttctaatgattgcggattttcaaacgccttttcattcatttgtttttctaatgaataaaaagcatttgttactaaatcattacgcaatttagttgcaatttcctctttaacatcatttaattcacgggttttcatatccaatactttaatgatatggtacgcattatccactttcacaggctggctatactcaccaacatttaataacgtcaccgcactttcaaaagcaagaggcatcattccattcacaacccaatccaaatctccacctttttgggctgataatgtgtccattgaatataattttgctaaagcagaaaaatcttcgccattttgtaaattagcataaactgattgtgcttcttgttcagtcggtaattgaatatgagctaaatgttttgttatatattgagctttattatcttgataatattgtgcaatttctatatcggagatttttactttctgatccgcaatcgcacgagttaagtctagatattgcactttaactctttcaggtacagcaaagttagctttgttagcttgataatattgttcgatttcttgctccgttacagtttgtttttgcatttcgtcatctaaagatagaacagctaaacgaacatcacgacgttggaaaaaattctttgctaattcattgagttgtataggaacctgaaaatcactatttgcaataccttgctgtaattgctctaataccaagccttcacgcacatatgcagcataagtatcagaactaataccacttgaagctaatatctgctgataaattttattgtcaaatttgccctcattttggaacataggtgagttcacaatagctaaacttacttgcttatcgctaattcctaacttaagttcttgtgcatattgacgtaataattcttgattgattaaacgatcgagaacttcatgtcttagatgtttagcagccgaatctgcaacttcagcaaatttagctcctaaattttcacttaaacgttgatattcattgttatattgctgtagaaaaacttgttgagaaatttcttcgccatttacttttgctacagatgtatctgtccgtataaacatataacctgctacgccactgagtacaaaagaaaccccgattaagccaaaaataattttagaaactataccgctagaggcattgttcaatttttccattaacattgaagaaatcctataaatgttagattaaaaagaaatgcgtaaaattataatcgaaagtaactcaattcgcacgattaaaataataattcatcaacaaaacactttattttatagattgaattaattctgtggtagtgcataagatacggtatcttagaattatgataaaaatatttaactgatctaaagtagtttaaaagtgcggtgctaattcatgacttttacgagtcatacataaaaaaagagtggatttcccactcttttattaaaaaccaaagtcttatctttttatcattcaaccactaaagcacggcaagtagtcgtaccatttgatgttaaatggtctccttgagttaataaaaccaaatcaccggaaactaaataacctttatcttttagcgattgtattgctgcttttaatccttcaagcgtacgactatcctgatcaaaatgaattggaataacaccacgatacaatgcacataaatttaacgtactttcatttcgagaaagggcaaaaattggtagtccggaactaatgcgagacatcaattttgcagtatgaccactacttgtcattgcgatgatggctgcaacacctttcatatggttggctgcaaacatcgtagacatcgcaatagtttcttcaatcgtatcaaattctttatctaagcgatgccgagaaatatttacactaggcattttttcagcacctaaacaaactttagccattgctgaaacagtttctgaagggtattgacctgctgctgtttccgcagaaagcatgacggcatcagtgccatctaatacagcattggcaacatccatcacctcggcacgagttggcataggattgctaatcatagattccatcatttgtgttgcggtaatcactacacgatttagctgacgtgaacgacgaattaattttttctgtattccgactaattccggatcaccaatttcaacacccaaatcaccacgagcaaccataattacatcagaagctaaaataatatcgtccattgcctcatcgtcaataacagtctccgctctttcaactttagccacaattttggcttttaaaccagcttgttgagctaattcacgagcataatttaaatcagcactggaacgagggaaagaaacagcaagataatcaacaccaatacgtgcagctaaaataatgtcttctttgtctttttctgtcagtgcgttagcagataacccaccacctaatttattgatacctttattatttgataatggaccgccaacaattacttctgtaaatactttagtattgtctgtcgataacacttttaactgaacacgtccgtcatctaataataaaatatcgcccggaacaacatcttgtggtaatgttttataatccagtcctacggcttcttgattaccttcacctttgggtaaatcagcatctaaagtaaaattatcaccaatatttaagaaaattttaccctctttaaaagtagatacccgaatttttggaccttgtagatctcctaaaattgcaacagttttacctaattttttagcaatttcacgaactttttcagcacgagcaagatgatcttctggtgtaccatgagaaaaattcatacgaacaacatttgcaccggctacaataattttttctaaattattacctcgatctgtggatggtcccagtgtacatactatttttgttcttcttagtcttctagacattcgttactccgtttaattattttgaataatataagattattaatttagtaaaacccgctcattatatgcttaaaataaaattagatcgagatcacattttggaaaattcttattatagctggataatggaaatgaatattcagattttttctctttttcttttcatgactgttgataaagtaagacttttatatattctttaaaaactttgttaatcatcaaccgcaccaacacacaaaaaaagcagtgattgctcactgctttttcacggtcattgaatgaaacctaccatgtccagccaacccctacaccaccgccgaaatcaccggcagagtttctgctaccatgtaatttcagcattattttaccattatcgctcaaacgcgaataacctaatgccaccgcattgtttcctttataggtacctgcagataaagcaaggctcgatttgcccggcatcgttactgtaggcaatgcggcggcagcatgtgctccagcaaccccggctctcaagtctttattgaatatctcaattttattgtcgagatggttgaatttttggtcagtatgtgtctgcaaggcatcgacatattgtttattagccacagcattcggtgatgagttcggtgttaaatcaggcacacggatttcaccttttgcaccgtcaatctcaactttctgaccttgtccgtttgtgaacgtcaatgcacttgatgtcaaagtagccttgttattaccttctttgagagtgatcccccccgaaccataatgtgcagactgattgtttttacctgtcactgtcaatccgttgccgtcaagacgggatttattcccctctgcggtttctttggtttcaaacgaggtcatatttttcaaggtatcggacaacttcacttccataccgctgtcagaagcagtcactttaatattgccggcagcggttgttgcactgttaaactcaccctcgcctttgatggtcaatttctcgcctaaatttttatggacaggcacgccgtcattgccctcaaaatttaagcccgcttgacctaaggctttcacgtcttgcaagtttgccccacggtgaacatcgacgctgttatcatccgataataatttattaattgcaccatcttttgcttttaaggcgatttgatagacgtcttgcttcgcttttaatatgccttgtgccgattcaacctcttttttcgccttatccaatttcgagttaatgtcggctaatgttgatttttcgccctcgatcttagctttggctttctctttcgccgctttttcctccggtgtagtttccagcatgaaagacaatgcggtttcaagagcgtcaatggcgtcctgtttcgcctcttttgctgtttgtagcgtcaacatatcgtctacttttttcgccaccgcctgtgcttcggttttcactgcttcgcccgcatttttcacgttttcagcttgctcttttgctttatcggcatcaatacccaaaccgctagccacgttgcccagcactacaggtttatcggtttcaccaccggtattgatcagagaaagttgcgtatctaccgcacttttatccgctttcggtgtaccgttatcctcaacgtcttcggctttatagtacttaccatcattggctttgactaatctattgccttgattatctgtaaatacgaccgttcccgcctcgccattgcgtaaagcgttcgctttgtcgttggcatttttgccatttaaaccgtctttgccggttaagcctttcgccgccatcgattctttgccgtctgatgttttttcaaaacctgacaatccatctttaccgtccgcaaagaccattatcttcggttttggagcagtttcagaagaatttggattatcaatccatttcgcccctgtagctttgacaagctgtccaccattgatcgcatctttggagtcagtcgataacttgccatcagcaatattgcttacaaccatggcttttggctcagccttaatcacgacctcgctttgtttgtccttaatagacgaaacaacatctttgccatctttggtgtatttaccgcttgcatatgtcgcatcctctaagtcggttggcttgtagaatttaccatcttgacctttaaccactttttcatcgcccagataataatcaaatggtctatttgaattggctgatgaaagtttttgatcaagttttttaacttccgtatccacatagtttttattggcgacacttgaaccatcggcaccatcagctaaatcagcaagaccggtaatcgcacctatatatttaccatcagcacctttaccaaaagatagggtcgctttctctttctctttacctttaccgtctttatctttggtaactttcaggctgattgcttcagttgagccatctttacctttcacggttaagccgtctttaccataaacagtgtgggttttatcgccattagttgcgtctttatcacccacggttaaacctttatcgttcaaggtcgcaatagtcggattaccatctttacctttcaatgtaattgcattgccgttgatattaacagtattacctttgtcgtctttaaactcggcagacttcaagccttttaactcctcattgagtgaaatttctagctggctcttagcactatccgccttcaccgcaatattgccgtcggtgcctttgaatgtagtaactttagctttatctaagcctttgcccacaatctccagtttttcgccaaggtttttatgcacaatgctgtcgctgttattaccggcaaaatccagtcctgcttgtgcgacagcttttaagtcggcaacattcacggctttatgcgatgaatctttatcaagctcgcctgacacgagttttttcaccaactcacgttgtttaccttgtgtggctgaagcaatgccactgtctttaatatcatcaatacccaaaccggatttgaggttatcaatcgcaacaggtgcaactgttttgcctgcttcaggtttaccgcctaaagtaatcgatgttttgttttcatcatcatatttcaccgccactttctctgcttcggagtgttgtgcggtgactttccctacaatagccttggcaaccgcagacaagtcttgaacattgaccgcattgttggcgatcttgttgcccttggtattgtccttatcaggtgttccagcgagtacgttgttaataatactgtcattattggtatcactgtcttttaagcccagcccactcgcaagtcctttaatttgtttggtatttaacgtcaagccggttctgtcaaagacaaaggttccaccattggattcaatgacaacattagtttttggttttgtaccattcgctccttgtttgttaaattcaatgctagaagcgatttttttacccttaccagctccgatttctcgacctccaatagacttaatgcctttcaaatcagaattgagagcaatttctagcgtagaagcacctttcttcgttgtggtagtgatattttgatgtgttttagccgaacctgaacccaccttacctttaattttcaagctgtcattaacggtaaatttagagcctttattcccctcaacttcaaattttgttgcatagttcgttaatttcgctgccaccgctttggaggtaaccgctctttcatcgtgttcggaaacattatccgctttattcaaagttaagattaatttagcattgtctccttccttttcgactttcgttttaatatccttttctttcatgcctctatcatctttcttggcttccgaactgtcgatcgtcaacaacttgtctaagttgaccagttgttctgtttgacctgcgtcatttcctttgaatttaagccctctttcgtccacatactttttattggcggcgtcatagttgtccgtcggatcggcaacaaacacaattttccgcttatgtcgcattgacccgactgacaatgcattggacttcgccagcgaacctgtccccaatacaatggcattatgtatctcatcatctgccgtgatattcgagcctaagatgatgttttcgtttccttcaacttcatttcttgaaccgattgaaatattctgtttaccggtgattttgttgtccgatcccattacgtaattttgttctttctcaataacgttattatcccccacggcaaatgagaagttgcctcgtaccgtgttttctctaccgataccgatcgaactcattccaagcacattggaatcttgacctattgatactgcaccggtattcaatgcgtttgctccgtaccccatggcaatagatccttcatttctcgatatcgcaccatgtcctacagataccgaaccatcccccaacgcttccgttgttggtgaatccgacactttcacggatttatctcctgtaccttttagataatctattaatgcttgtgcttgaactaattccgttgtgctttttttaccattttcaagatttattttgccaataccgacattttttccaaagtcagcttgtttatcatcaatattcgagccatctacttttaaatacgccgtgcctaacttatcaactaagtcagtagtcttggtataatttttcaacgcgtccgcgactgcttttgaggtaacgacttttccgttgttttcctccactttatcagctttatttaatttcagcgtaagtgtacccgcactttgaggatcgctaccattagatggtgctaatgttaccgtgatgtctttttcaacagtcgcactatttgctccagtcgtatcgctactactaacaggcgagctatcaatggtcaatgttccgcctaattgtaatgtggtttgtgtcgacttgtcgtcattgcctttaaaggtaacacctttattgaccgctgtaattagcccattaatcgcatctttataggtcgtgtatttatcttttgaaacggtagaagttgtatctgtatctgtatcatctcccttaactttagtaaatgatggtgcggtaaagttaccagttttatcaacagaaagccctaaattaccgactaaatcgtgaagttgtttaccattaatcgcatcagttgaattctctgcaatctgtccaccagcgacatttgagattttaacgtttttatccttgtcagtttttccattcactggggtaaaagttaacgcatgtccaccgacttttaactctgctgtgttcgtgctacttgatccatctgtgttactcgtatcatttttaaacactaaagcgttgctgtcatctttaccaatcgactcaataccttttaagtccttattaagtgcaattgttaactcacttttactagcttttgtagtgatattttgatgttttttgttatctgtagctgtagcatttttagtttccgccccttttatagataaagtcccactgatattatcagtattaccctcatctgaagttaccataaatgcagaggctttgtttgctagcaaattatccacatattttttgttgacggcgtcataatcttgctctggatcgcctacaaatactatgcgtcttctatttctaggtgttcctactgataacgcattagataccgctacagattgatttcctaatactattgcattttcagtatcttcaccaacatttatacgtgagcctaataatatatttccagttccagagacttcattattagatcctaataatatattttcatctttttctattttattactagaaccaatagatatatttctttcaccacttatattattatttgatcccattacataagttgatgttgattttgaacctatctcattttcatctcctactacaaatgagaaattaccattaactttattatctttacctaaaccaattgaatttactcctaatacatttgagccttgtcctattgatatagaccctgaatttaatgcattggctccatatcctaaagctattgagccttcattttgtgattttgcatcgtaccctatagaaatagagccttctccctctgcaattgtttttgaagaatcagagacttttacagatttatcccctgtgcctttcaaataatcgactaaggctttagcttgtactaattctgttttttcttcatcatcaagttttatttcactaattcccacattagatccaaattctttttgtttatcgccaatattttctccagtgattcttaaaaagtcttcttctaatgtttctgtagtagcgaaatcttttaatttatctgctaccgcttttgctacatctgacaagtcttgaacatttactacattattttttatatcttttatagaatctccaccagttaatacattattaacattacttgtgggagctccgccatcgcttggtgtagttgaacctattccacttgcaacatttttaatttgcttgctacccaaatcaagaccatctttatctaatttaactgttgccttatttttaccttcgcctactgtaaatgtaatatgatgagtagaatcagcactactaaattctattttagccttatcatctttaccaatagaagtaatccctgttaaagcctgattaagcgatatggttaattttttattgcccttatcaacggcggttgtaatattactatccccattaatagttaagacattattgtccttattaatttcaagacttgtgttttctccctctttaggcgtgtcgccttttaccgtaaagttagaacccacattttttaatctcttgtctaaatattttttgttgacagcatagttatcataagtatttttcttagcactatctgacgtatcctcaggaatttcttctgtaattaatacatttttaaaagtaggggattcttttatacctattaagatatttttattatttttttcatactgagttctaatattatcacttaaaaatttatcttctttgtttaaagcatcatctttaactgttatattcccagccttaatgattaatttatcgcctaagtaatgcgttccttgttcatcgccatctccactgccaaaaacaaagcctttattaatcgctgttgtattttgagcgattgccgctttaaaggtcatttctgttggtgttgtcgcatctgtatgtccgctatatttagcgacttcaaattccgatttcttaaatcctgttttattagcgtcttcaacttccgcacccaatacattcaccgctaattttgaaaattcatcggcgacggcgtaaagttggctgccgttgatagcgtcggtcgacgttgccgttaccgcaccagcagcgacgtgtttaatgatacgctcattatttttcttacctatgcttaacacggattttttattattttcttgaccattagcactcactccacttttgaaattaaatttaacattaatagcctctattttagcttcattaagtgcggtttcttttttagtcgcttctgacccttgtcccaacgcaatggagttgccggcggcggtttcaactaccgcactttcgcctatggcgacaccgccctcggctttagattgggcttgataaccaataataactgcgttttttgcaccattttcagcttttgtttctgctccgataagtacgctgttttttgcattttgggcattggctttattaccaatcgcaactacgtgtgtattagcgaatttgtcagaaccattgccctcaaatcctatattaatattgttccctaacgccagtatatcggtcccgttttggattttgtttttattcccgatagaggttgtccaagcggcgtttttgatgatagtaccctctgttccatttttaccgttcacaaaaaccgcaccgatggcaatcgaactcttggactcttctaattttgttccgctaccgatcacaacaaccgcacttcttgtgtttttatcactttgtgtaacagtattattggaacccaacacaaacgaattaggtacatcaacactgacatttgtccctatgacgatagcgttttgagcttttgagcttgccccattaccgatcgctacgccggaatcagctgttgcactcgcaccgacaccgatagcaatagccttatttcccgttgcccctttgttatcataatttgaaccttgttgagtaggattattcaccgacaaataatgcaaagttcctacattttttacgcctttcatcgcttcttttaattgagcaaggataacaacgtcggtatctttcgtacccggtgcgacgttgacgatttgtcttagaattgtttttttatctccgtttttttgtttactaatatcgccaatatctccaccatttttcccaacagaaacgggagcatacatattaccatctagttttcctgctaattctttactaatatacgcagtgtcatttgctttattaatacgttcatgtgccctatcagcaaccgattgataacctaaagctactgcattcgcatattttgttgaagtctcatttcctaataaaattgaattacgagcatccatctcatctatcgtagcattttgtcctataacaatagagttttcagcatttgatttagccccaaccccgattgccatcgaacctgattttttggctccatcactaaggaagttacttttagcaaatttttctttttgttctggtgtaaataattttttcaattcatcttcggctgtatcctggttataagcattttcaatatctttatatgcttgttctaaccattccttgcgttttttcttttctaattcaggatcttgttttgcattctgagttagaagtaatttataatttttttcatcttcagtttttaatttttctgcgacatttttaaaatcgctatattttctttcgtaggcttctactttactttttatattctctaaattaatttcttcgttgtttctttcttttctcgctttgagttttaaatattcctttttaactttcgcatagtttttgtaatcctgttcttttgtgactaatagctttaattcatctaagcctttgacagagacatatttcacgccggaattaatattatcttcttctaacgtatttccatacaggatagcttcttctaaggctcttaattgagatacgttgaccgcatcagtatcgctcgcacccggtgcaacattgacgatacgtctttccgcattctttccacccactgacaaatagccgattctttctgatgaaggtattgatatggcatttttaggtgcccatccgccttgtgccatttcagtttgagtataatcagtttttgcattgacgcccaatgcgatggaatctgaaaaagaggcttccgcaccattaccaattgccattgcatttttaatggtaaaatctgattttccattgctcttatttttttcacttcgaagtgcggttggcatttcagctaaaacttttgcctttatacctaatgccatagaatcatcagcttctactaatgaatgagtaccaaaagcaactgattgtttacctaatgctcttgtgaaatttcctattgaaaatgaagattctttttgtgcaaacgcaaatctaccgagtgcaacagtactatcttctttcgcataggcatatctacctaatgagattgcattatcccccaatgcaacagaataagaacctatggcaatagcaccttgattatgtcttcccaacttatctttagattgctctgctttttcttcgcccgttccttcttggacggttgtgtgggcattaatatgttctttcattatatcttgtatcgctgctgtatcaccgaaacgatataaatcttcaatagtgattttgttgtctgttaatccttgtggaccgccattagtgtatgtagggtaattttgtttaccgtttactaataagttatattgatcaatagtaagcccctcaccattaaataccttacccatcttcacattggcaaaggtgtgatcaccaatcgctaacgatcctaagccccctgcaaaagagtctttaccatataccatagatccggcaccgatggcttgtactttattcccgatacctacagatccgtctgcatagacatagctgttattacccatcaccaatgaacctttaccaaaggcgacggtgtttgagccgatagcggttgaataatctttagccgctacagcaaatgcccctaaagcggttgaattatctccataggcaatcgaacgtgccccaatagcaatggcgttatttcctcttgcccaagtatgtgttttggtatttctatgatctgctaaatatttttgataagcctctccttctttttttagatagagttcatatcttttatagtctgataatgcctttatttgttttattttttcttcatatcctggggtgttaggatcgatataatttttatgtacggcgttttctgattcaacatcataaaaattttccccctctatgcggtaatatccatctttatagtctttaccattttttctcacaaaatatgtgccgttttgatatattggtgtgtaaccatctttagctaataactgtccttgatcattaagcataggcttaccggcattatctgtagggatctgaaaatcaacggcagcatattctttggtatagttaaaatcatctcttacattataaaaaagtctaaacatctctttagaaagcggtttggcatcatgccctgcggcattatcgcttccgatagaaatagaggaatctccccatgccaccacatcgttacccaaagcggtcgcttcttcgcctcgtgcaaaagatcgataaccgacagccgtaccttcttgatttaaagctcttttaggatctgttttgcgtttctcttgctccatttgtacgacttgagcaataatgcttcgttttttttcttctgctgtaattttccacttaggatcattggcaaaattaaaatacttttcccgtaattctttatacgaatcatcttcgcctctgagcagaatagatttagcttcttcatacgtaacggttggattgttagctgaagtcgctgtattttctccggtagcggctccaaaaccgatagcggttcctttatcaccgcccacgactgctcgagaccctatcacaacagtttgattaaagtctttattgctatacgaagcattttttcctgttttattagcataatccgagaggataaccgcttcatcgggaatatcagattgtttatatggtcgattccaagatccatacataatttgcgttttacggtttaggttgcttatcgtttgtccatctgcaacatctttatcatgaacccaaacatcatacccatacgcaactccagacaacaaccccgacatcaccaacgccaacggcaggaccttaaacgcccctaacattccgccgaaaaacacaccgcacttcggctgacttcccgccgcctcaacacggctcgccacctgacggttattcgctaattcagacacaactttcgtttgacctgttgttacatcgtatttggttttgaatattttgttcataaattcactctctttaagcttttaaaattaggttttttaataatgtatgttgtcgattttttaacttttacggttgtttattgattaaacgtgttactttttagatagattgataaataaatcggcgatgccttgctttttaagacaaagcagaaaaaggcgaataatactttcgccgaaaggttgaggttgaaataggtgatttttatttttaagatgttgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcatttttttcgttctattttatttgtcaagtaaaaattcgggttattctatctcaaaattgttatgggaaaaacgattttttatttttttattcacttttttgtttgttatcagctaaaagatattttttggcggcggctaaatattgaaacattgaccaaactgtcaacatggcggcgatatacaaaaagacaattgctgtaatttccattaatgtattgtagtgccataaaagaccgccaagtgcaagcatttgtgaggctgttttaattttccccagccaagaaaccgcaacgatgccacggctaccgatttctgccatccattctcgtaatgctgaaatcacaatttcacgaaagatcataataattgcaggtatcgttacccaaaaaacatgttgatattcaacaacgagcgtaagtgccgcaatgaccatgactttatcggcgacaggatctaaaaacgcaccaaaaggcgtactttgattccatcggcgagcaaggtaaccgtccagccagtctgttattgaggcaatgaaaaaaataatagttgtgagaaaaggtgcccaatgaaaaggcaaataaaatgttacgataaagaacgggattaatccgactcgaaataaagttaagattgtaggaatattgaatttcataatgctgttttgagtagagtagggatacgctgtattctaaagtatatcccttatttttaaaagcctgatgaaactaacaaagtgaaataattagttgtttttgatatgggattttaacgtttgttcaatttcataaatccaatcgagttcatattgagtaaaaccggcttggatacgagcatcagtattaataactcctttaaaaatcacgatgcgatatttacgtaataattcgctgaaacatttcattgcatctaattgacgtttagcggaaagtgcgtgataccaatgattcccaatagaaacatgaccaatttcgtcacgcaaaataatatctaaaattgccactgcctcgacgtctttacgctgtgcaattttttcttgtagtattgggtttgcatctaatcccctggcttccaaaactctaggtaccaatgccatacgctcccaaatgtcatgagccgtcgcttgagccatttcccataagccggcatgagcctcaaaatcgccatattggtatcctaatgtgtttaaatgctcattaacgagagtaaagtgagtgctttcttcacgtgcaactttgagccaatcttgtatgaacggcatgccttgttcgagttcctcttgtgcgtgacgtccaaatctccacgcagcatctaaaccaaggtttattgcattaaattcaatatgagcaatggcatgtaatgttgccgcataaccttcgtttgtggcaaaagaacgtttaggcacattttggggagcgacaaggaagggtttgtgtggaataccgacaatttcttgttcaggtgtaacaagaggaaaatcgtccgtttgatctagatttatcgtaggcaaaatttcatcatataactgattcactaaacgacatttttcatagggatttgtttctgccagtgcggttgttattttatgccaaaagtcttgagttgaaagtgcggtcatatttttccttatttcatagaataatttttaatcgctcaaagtatagttatcagagaaagatttgcaatcggaatttgcttataggataatgcaccccattagccgttcggttaattctatggaaatcttttcggttcctcgcaatagtgtccgatttactcggtcaggttcggaagaaagcagccaaagtcggaatttctgtgtgccgagatcctgccggaaaggtttccgcccatctactacatttcaatatgtataaaaaaagcaacttttcagttgcctttattcaatttagctttgttcttttactgcctctaatgcacgcaaggcataagtataagccgcaccagcgttcagtgcaatcgcagtagccaatgctccggcaatttcactttctgttgcccctgctttagctgctttttcagcatgaacactaatacaactttcacaacgtgttgtaatagcgacagcaattgcgatgagttcacgggttttttcatcaagtgcttcagccgcagcagcctgatctaagttaatataggcttgtaacatttttggatgagacttgcccaattcgccaaaagatttttttacatgagcggtatgctctttccaatctgtgaatgttgtcataagaatttcctcttgttgttaatcaagttaatgttgataattaaccgcacttttataacttgattgactaaaagtgcggtgtaatttgaacatattttttagatttaaattcgttcaataagttgtttaaaaaatcctttttcttgttgaatcagttgatggtaatgtccttgttcaactagatggctgttatccatgatacaaagtaaatcgaattgttcaagtgctgttagacgatgagtaaccataatgaacgttttattttgacaatgttcaaataatagcgttagaacatggcgttcagtatctcgatccagtccttctgtcggttcatcaagtagaataatgggggcattattcagtaaaactcttgctagtcctaagcgacgctgttcaccgcctgataaaggtcgcccgccgtcgcctaaccataaatccagtccttgatcctgcagaactaatttttccagacctactttttgtagtatatgacacattttttcatcgctgatttgttggctacctgctatttgtaaattattgcgtaaagtatcactaaaaatatgtactcgttgagtgagtaaacagatattttggcgtagcgtttcttcggtataaacttgaatcggtgcattagagagtaaaatttccccttggttgcaatcatagtttcgaaccaataattgcagtaaacttgatttgccactccccgttttcccgagaacagccactttttttccagcttcaacggttaaattaatttgttgcaatgcctgatcattacgatccggataagaaaaactgacatttttcagttgaataagcggatattcattgttttgcaatatgtgagtaccgttgaattgcactaaaggtcgttgtgcaagaagttcattaatgcgttctgcagatgaaatgacttgtccaatatgtaagaatgcgacactaataggcatgagaagctcaaatgaggcaagagcggcaaacgcaaataacgcaataaaagcattgtgataatctgcaatggaaaattgtgctttcgccgcaaaccaaagggttattactaccagtaatccgttaataaatacgacaagtgcggtagataatccgactaaatttgtttcttgttgttggtaagattgccattctaattcgattgcttttagtttctcttttgagctaaaggctgcattaaagagtaacagttccgcttgcgactgaataaattcgataaaataagtgcgataaactgaacgagattgagttaatttagcaccgaatttacgtcccagccgataaaaaacgatgggaataattaaaagtagcaacagcaggcttataccaataaatacgccgatagaaacattaaataaacttaagcctaatgtaataaaagcaataacaatcattgcactgataaaaggggcaataaggcgtaaatacaatgtatctaaagtatctacatcagccactaaacgattaagtaagtcactgttgcgatagcgattaagtactgcggggcttaaaggaataagtttactgaatacttgaacacgtaattttgccaatacacggaaagtggcatcatgcgtcactattttttcaaaataacgtgttacagttcgaccgattgctaaacctctgacacttgccgacgggtagaaaaaattaaataatgtgccaataccggctaacgccgtggcggcgagaaaccagccggatagggttaataaaccgatgcttgaggctaatcccgcaatcattaatattccccctaaaatgagagtaaatttagcgtgataaaataagcgaagaaaaggaagtaaagctcgcattattgaatttcctgtttttgttgagccaaaagttcggcgaagaaaccttgttcttttaattgttcaaaacggccttgttgcacaattttcccttgttgcatcactaaaatttggtcgcattgttttagatcttcaatgcgatgcgtaatcattaaagtagtttggttacggctaattttttgtaacacttgtagtacggcattttccgattttgcatcaagacttgcagtaggttcatcaagtaataataaattgctttgacgcaataatgagcgagcaataacaagacgttgtgcttgtccgacggataaaccaataccgccttctctaattagaaaatcaagtcctaatttcgcacaaaaagacgtggcttgtgcttgttctaatgcttgcataatttgttcgtctgttgcttgaatatcaccaaaaagtaaattttctcgaatcgtgccttgtaataataaaggattttgccctacccaagcgatattttttcgccattcgtttaaagataaatcatgcaattcaataccattaatttttaaacttccctgataatttaagaaaccgagtaacacgttgattaatgttgttttacctgcaccgctttgcccaactaacgcagtattgctttgagccgtcaagcaaaaatttaacggagcggttaaaggatggccttgtggtgaaagtgcgatgagatttttcgctataatttcgaccgcacttttaggctcgatactatatgtttgttcatattgttgagaagtaacttcttgctccaaaaatttaacgatttcatcggctgcaccaatacctgctgcacgatcatggtaataagcacccagatctcgtaaaggttggtaaaactcaggagcaagaattaagcagaaaaagccaataaataaagtaagttcagtgtcgtaagaaccaaagttaatttgtcctaaataactaaaaccaaaataaactgccattaatgcaatagagatagaagtaaaaaattctaatactgcggaagataaaaatgccatttttagcacagtcatagttgtttcacgaaaatcttcagtgctttcttcaatatattcagtttgctcttttgttttattgaaaaggcgtaatgtttctaatccacgtaaacgatctaaaaattgaccgctaagttttgctaaggcggacatatttttttgactactatctgcggcggctaatccggctaaaatcataaaaataggaataagcggagcagtaagtgccaagattaatccagccgcccaattgagtggaaagacagcgattaagataatgattggcgtaatggcagaaagtgcttgttgaggtagaaagcgagcataaaaattgtgcagattttctacttgttccagcatcaaggttgcccaacttcccgcagatttttggttgatcattgctggaccagcttgatgaattttggcgaaaatttgttgacgaatatgatgacgtaattgttgaccgcatttaaagcccactttttcccttgcccataatattaaaccacgtagcataaaaccaagaataagtgctagaaagtgcggtattaattcacttcgatccgtatttaaaataatgagttgatgaagcaggtagcttaaaatataagtttgtgcaactaaaataatggatgaaatagttgcaagaataatattaagcgaaagcaactttttgattggcttttgttgtttgcgtagccatttgaaaacatacttttgacgtgatttttccattgttactgctagaggttatgatatatttgtggggcagattagttgccccaatacgactgagttaattatttttgtgtatccaaaaaacgttctgcatctaaagctgccatacatccggttccggcagatgtaattgcttgacgatagttgtgatccattacatctccggctgcaaaaactccttggacagatgttgccgttgcattaccctccaaaccggattttacgacaatataaccgttgtttaattcaagttgattggcaaacaattcagtgttaggagcatgaccgatcgcaataaataccccttctaatttaagatcttcaacattttctgtttgtgtgttttttaaacggattccggttacgcccatattatcacctaaaacctccgctaaagtgcggttcgtatgcaggataatttttccttcttccacttttttattgaggcgatcgattaagattttttctgcccgaaacgtatcacggcgatgaattaaatgaacttcagaggcaatatttgcaagatataaggcttcttcaacagccgtattaccgccaccaaccacagccacaggtttattgcgataaaagaagccgtcgcaagttgcacaagcggaaacacctcgtcctttgtaagtttcttctgaaggtaagcctaaataacgagccgatgcacctgttgcgataatgagtgcatcgcaactgtaagcccctgcatcaccaaatagtttgaatggacgttcagataaatcgacattattaatatgatcgaagacgatttcggtatcaaatttttcagcatgttgcaacattcgttgcattaattccggacctgttgtatcaccaaagtctcccggccagttttctatttcagtcgtcgtggttaattgtccaccttgttgtaatccggtaaccaatacgggttttaagtttgctctggcagcataaattgcggcagtatagccggcaggaccggatcctaaaatgagcagttggctatgtttaaaatctgacataaaaatccttgttagtaaaatcttgcaagattgtgggttcgcttattatagagatttcaataattaaatctatcattaaatagaaaaccatagtggctattatgttgctggagacactatttttaacattaatacttgactgtgtgtccataactttcaatgatagatttgatatgttctagagaatctttagttggagggactacatcttccagttcatattgttcgcccatcgttttccatttatgtgcacctagctgatgatagggtagaagttcgacctgttcgatattgctcatattttgaataaattgacctaataagtgtatatcttcatcagcatcagtataaccgggaacaactacatagcgaatccaagttttttgattgcgtttttgtaagtatttggcaaattctagtgtacgcttgttcggtacaccgataagattttggtgcactttatcattgagctgttttaaatcaagtaaaacaagatcggtaacatctaataattcatcaatgacatgatcataatgacgtacaaagccatttgtatccaagcaagtacttattccttctgctttacaggctttaaaccaatctcgaacaaattcagcttgtaagacagcttctccaccggatgcggttacgccaccgcccgttgcattcataaaatgacgatacgtgaccacttctttcattaaatcttctacactgatttctttgccatcatgtagatcccatgtatctcgattatggcaatatttacaacgcattaggcagccttgtaaaaataaaatgaaacgaattcccggcccatcaacagttccacaagattcgtaagagtgataacgtgcaagtacagacattctgctttccttttaattttaaacattctcaaatcgtaatttgtacattttagcagaaataaaagaagaaaaacggattttattatttcatataaatactacatcttatgattaaaatttcgatttatttctatttgttttttattttaaaaatgtgatcaagatctaaaatttcgaaggtgaatctttttgtttttatttgtttcgagtaaaataaaattagaaaatatacgaaaataaataaatgtaagaaatggagataaaatgaacgaatctcaatcaaaacagcaacgcttaaacaaattgtacggatcagaaagagtatttagagcactagctattgatcagcgtggtgcgttaaaaagaatgctaggtgacgatataagtgataggcaaatgcaagaatttaaaagcttggtatcagaacaacttaccccttacgcttcggcaattctgcttgatcccgaatttggctggcaggcagctgaattgaaggatacaaattgtggtttaattatggcatatgaaaaaacaggctatgatagaaccaaaattggtcgttttcccgatctgattgatggtatctcggtaaaacagcttcaagagaaaggagctgatgcagtgaaattgctactttatatcgatgttgatgaaggaaaggaaatcaataatgtgaagactgcttttgttgagcgtgtaggttctgagtgtattgctgaaaatatgcctttctttttagaaattctgacctatgattcaaaaatttcggataaaaaagaattcgaaaggttaaagcctcgtaaagtgattgaagcaatgaaattattttcagataaacgctttaacgtcgatgttttaaaagtagaagtgcctgtggatatgaattttgtagaaggcttttctgggcaagaagcgatttataaccaagaatctgctgcagcattatttaaagagcagagtgaggcgacccatttacctttcatttttttaagtgccggtgtatcaccgcaactattccaagatacattatgttttgccaagcaagcaggctccgattttaacggcgtactttgcggtcggtcaacttgggcaggtagtgcggaatcatttaagactggaggtaaagaggaagccattgattggctaaaaaatgatggaattaaaaatattaccgaattaaataatgtattaacaaaaacagcgaaacccgttttttaacaggagaattagtatgcaaaacttacttaaacgccataaaagtggtgaatctgtggggatttgttcagtctgttccgctcattcagcggtaattgaagctgcattacgctttgagttgaacaccgaaaatgatgttttaattgaggcaacatctaatcaggtaaatcagttcggtggttatactggaatgcaacctgttgattttaaaaattttgtttacagtattgcggataaagttggatttcccaaaaaacgtattattttaggtggagatcatcttggtcctaactgctggcaaaatgaaccagctgaacaagcaatggagaaagcaaaggtgcttgttgccgaattcgctaaagcagaattcaccaaaatccatttagatgcatccatgtcttgtgcagatgatccggttcccctaccgccgttagtagtggcggaacgtgctgccgtgctgtgtcaagcagtcgaaaatgctctagattttgcaaatcgggataaagttagttatatcataggaacagaagtcccggtaccaggaggtgaaactcatactatctcaagtgttgatgttacaacaattcaaagtgccaaagaaaccattgaaacccacagacaagcatttgaagcattaggtttacaagaagcatttaaacgtattgtcggaatcgttgtgcaacctggagtagaattcgatcattccaacgttattttatataaacctgagttagctaaagatctttctgctttcattgaaagtacaccttatattttcgaagctcattcaactgattatcaatctcgagcggcttatcgtaatttagtaaaagatcactttgctattctgaaggttggtcctgcactcacttttgcgttgcgtgaagctctttttgcattggcaaaaatcgaagatgaattaatcatccctgagaaaaagagttatcttttagatgtgattaatcaggttatgcaagatgaccctaagtattggagtaaatattattctccacaatattcaaaagcaataattgagctccatttcagcctttcagatcgtatccgttactattggccgaatgaacggattaacagtgcggtagaaacacttattgaaaatttatctgatatttctattccgctgggtttattaagtcagtatttacctaatcaataccgtttgattgtggatggcatattaaaagcgaagccaaaggaattaattataaacaaaatccaacaagttttgtcggattacgcctttggttgctacggaaaataacaggaggaaattttggtaagtgaaatcttaattaaaactggtatttcttttgaaaattattctgaagcattaaatcatattgctgatgaattaattgcaaaaggttttgtgaaagaaagttatagagatgctgtattcgctcgtgaagcaaatttcccaaccggcatccaactggaggaacattctgtggcaatcccacattgtgaagctgaacattctataaagccagctatctattttatccgtcctgataaaacattagttgttaatcgtgcagatgatgatggtactgtggatgctgaaatcctaatggcattagtcgttaccaacccacaacaacagcttaggctgttaagaacacttttcggtaaattgcaggataattcatttgtaactcaattactttccattcaagaaagcgatttatccgaatttctcaaacaacattttgaaatctagtcaatgaaaagagggaactcattatgaaaaagaaagttattgtcgcttgtggtggagctgttgcaacttcaacattagccgcagaggaaatagaagaactttgtgctgaaaataatatttcggtagaactggttcaatgtcgagtaaatgaaatcggtagctatatcaatgatgttgatttgatctgcacaacagcaaaaatcagtcaaatttacggtgatattcctattgttcacggtatgccgtttgtatcgggtgtaggtattgatgaattaaaagaaaaaatcttggttattttaagaggataagattatgttcacagaaattatgcaatatattttggatttaggcccagcggtaatgttaccactggtaattctcattctctcgctagccttaggtatgaaattcggagagtctttcaaagctggtttatctatcggtatcggctttgtagggatcgggctcgtaatcggtttaatgttggactctattggtcctgcagcaaaggcaatggcacatacctttgatattcagctaaatgttatcgatcttggttggcctggagcttcaccgatgacttgggcttcacaaacagcgttaatagctattcctattgcgattgcggtaaatatagcgatgttgctgttaaaaatgacccgtgtcgtaaacgttgatatttggaatatctggcatatgacgtttactggtgcgttagttcatattgcgacaggttcgtattggttgggtattcttggtgttattgttcatgctgctttcgtttataaacttggggattggttttctaaagacaccaaacatttctttgaattggatggtattgctattccgcatggaacctcagcttacttaggaccggtagctgtattggtggataccattatcgaaaagataccagggttaaataaaatccatttttcagccgatgatctacaaaaacgctttggtgctttaggcgaacctgtaaccgtaggttttattatgggagtagtaattgggttacttgctggctattctatgaaagacgtgttgcaattagcagtcaaaactgcaacaataatgctgttaatgcctcgtgtaatcaaaccaatcatggacggtttagcacctattgccaaacaggcccgtaaaaaattacaagcacgtttcggcggtagcgatttcttaatcggcttagatcctgcattattacttggtcacacctctgtagtatctgcaagtttaatctttattccgcttactatcctaattgctgtgttcttaccgggtaaccaagtacttccatttggtgatttggcaactatcggcttcttcgttgcaatggcagtagcagtacaccaaggtaacttattccgaaccttaatttccggtctgattattatgtcgatgaccctttggatcgcaacccaaaccattgcgtatcatactcagctggcagctaatgcaggaacattaaaagcaggagaacaagtcgcttcaatggatcagggcggttcaccgatcacttatttgatgattcaggtgctgacctttgaaaatattgtcggaatgactattattgcaatcatttacttttgcggtgtattccttacttggcgaagagccaaatcctatgaaaaagaaatagtcgctcaatcagcacaaaattaaggaataataaccaatgaaagctattgttttagaatctaaccgtaatatggctatttgtgatattcctaagcctttagtcgaagaccctgatgatgtgttggtaaaagtgcattactccggactatgtggttccgatattccaaggatttttcatcatggtactcacttctatcctattgttttaggtcacgaatttagtgctacagtagaagaagtaggctcagatgtaacggaattggataagggagatttagttagctgtgctcctctccagccctgttttaaatgtgatgaatgtaatagagggttttactctttatgtaaaaactacaattttatcggttcacgccgcttcggtgctaactcagagtatctttgtgtgaaaaagagtaatttggtgaagttacctcaaggaagtgacacattgcaagcatcttttattgagcctatcactgttggattgcatgctattcatcttgcaggaggctgtaaaggtaaaaatgtggttatagttggagcaggtactatcgggttactggcagctcaatctacaaaagcattaggggcaaattcagttagtgtgattgacatcaaccaagaaaaattggtgttggcaaaaacattaggtgcagattacgtatttaattcaatggatttgaaagctgacgaaattctagcctgtttagatggtaatcgatttgatcaactaattttagaaacagcgggggtaccgaaaactgttgaactttccattcaaattgctggacctagagctcaagtcgtattagttggaacactacaccacgacctaaatctcgatcaaaaagaatttggactgattttacgcaaagaacttatcatttttggttcttggatgaattactccaaaccttggccgggagtcgaatggcgagaagcagttaatcttattgcagaaaataaaatctgctttgaaccgcttatctcgtcgattaacactattgaagattatgtggaagaagtgaaatccttagacggtaaaccgatgaatggaaaattggtattaaaattcgactaattgtaatacaaaactagtattaaaattcgattaatcgtaatataatgaaagcgtatgaaacttcatacgctttattttttagcggaaaatattatgaacacttttgaaagacgacatcaaattatagaattactcaaagaaaacggaattgtgtccgtcaatgatctcgccaaacgatttaatgtatcggaagtttctgtgcgtaccgatttaagaatgctggaagaacaaggaatacttactcgttttcacggaggtgcggcattttcaaattcaaatgaaaagccatacgaaaaaaaagaacgaaacgaaagtaaagagacttcacttgaagaacgccatggtctttcgcacgatccgaaatcccatattgcccgtattgccgcacaactggttaaggaaggtgatactgtcattcttgacagcggcagcactaccttgatgattgcttacgaattacttaaaattaagaacattactgttattactaacaatcttcctgctgcagtagtactatccgattcacctgatattactcttgtaatttgcggcggtacgcttcgtcacaaaacccgctcaatgcacggtactattactgaaaattcattacaaggcattcgggctgatattatgtttgtgggagccgatggtgttgatgccaaaataggactgacaacctttaatgagggctacaatatcagttcaattatggcagatatttccgccaaagtagtagctgttgttgatgcaacaaaattcaaccgtaacggctttaaccttgtacttccaatgcaaaaattggatttagtcattacagataatagtctgacaaaggaaaaacagctggaattaatttcggtgggtgtaccgttacagttagcctagtaatcagcaaaggcggtcatatttttactaaggtttgtaaatacctaaataccgagcttggtatttggtttattgaactgtccgatttttaggaatataggaccaaattgttttgttttaatcatcgaactcatgaaggtatttcaaagtgctgtaaacccattttattagctgagaaaaacctctaagaaagatttaaaagagtttaattcaagagacaaaaaatggcggtaattatatcatgcactattaatttgtaacgtattctttggattgttcgggaataatgacccctaaatcgatccatttgtaccaagtttgttgcagaaattgtagtatgttctcgtcaactgcaaggttttttaaagattcttttagcttttgtagtgaataggctttttcttgtaacagcattaataaaaagtgatctaagtccgttaacttttggtaatacacttcaaattgagcattacgccaaacaattgtttttgatggttgattcagtatttggttaaactgagttgaaagaaaatccaccggatattctcttataaagcaaacttctgagcatttcattggagtttgttctgttatatcgaattcagtcggtagctgaaacattgatacttccgcttgaagttgatcaaattcaaattgcattagggagagaatattttcatcgaaaatatttttgtgttggcaaaattgtaaaaactcacctgcaatatcttggaagtaaggggaatgtgcttttccgtttttgacaaattcttcttttgcattatcccaatcttgtcggtttaaatgagccggagtttcggtaaagcatttttcgataaagccaaaagtattgttgcgtaataaccgcacataaatatttaaacgtctaggatcgtgattgctagggtctttttcacgaatagcttgaacaaattcttgttgcgtttgtgctagatttttagccatgacaatcctctttttttgacatatttttgttgtaagtgatggataatatcgacttctttacaaagtttttcaaaaggagggaaattgaaatcacgttcaagtagtgttggtggcatatgaggtaaacgtgcataagtatattccagtaaatcccaaacggtaccttttacattttcaccatgtgtatcaacaagtaattgaggaagatggcgaaaatctcctttgattgtattgaaagcctctgatgtttgtatttgcacttcagtagcggcatgttcgtcatcatgtccggcaatatgaatgtaattgacacgttttaaatccacattatcaataaagacatgaggatcaagtaatccatggttgaccgcatttacatagatattattaacatctaaatgaatgccacaatttgcctcttgtgcaatagcattgagaaattctacttcattcatcgtgcttgtttcagaatgcaaataataagaggtgttttctactgaaatttgaatttctaaaaaatcttgtacttcacgaattcttgctgcagtgtgttttactgcttcatcagtaaacggcattggcaataaatcatataaatgaccatcgcattcacaaaagctcagatgatcggaaaagaaaggcgtattatattgttttatcatggctttaatgcctgataataattctttatctaaaggggcttgtccaccaagagaaagagataacccatggattagcatagggattttttctgccactttatcgaattgataacgagcaaatcctcccatttttagccagttttccggtgctatttccataaattgaattcgatcattattgcgtaattgtagaaatccttccgctagatcacgtctgtagcctaaaccggcaccttgtcgcatatatcctccgtgtaaataaaaagggtgcgatgcaccctcaaaaatttatttagatgcaccgcactttccttcgccacatttgccttcggcagatttcggcatatttttcttaggagcggttgcaccgcattttccttcaccgcatttgccttcggcagattttgatacacatttgccatcgtgcatttcacactcggttgtgttttttttcatatctgcatgtgctgatacagccatagctaaggcaccggctaaagcgactaaagttgtttttttcatggtttttctcctatataaatgattaaagtaaattcagccgtttttgagctgagtattttttccgtaacagaaaatcaagtgaaactacacccgcaccttgtaggagcagaggaagtaacgtaattatgtaaatgagcggtaatttataaccattgttgcatacgttataacctaatccgctatgtactgttgcccaagctacagcggttaaaatcatcaaccctaatgcactaaagcgggttgcaatacctaaaaccaacaaaatcggaaacaataattctgcaccggttgcaatagcccaatttaagtccagtggtaaaattgagaaaggaaacggaaaattatcttttaccgcataaaaccaattttcaccgttccatttttctagtcctgcttcgaaaaactcataggcgacaaaaaaacgtaatacgagtaaggataatccctgagtggattgtttaaaaatatgacaatgagacattttctactcctaaaaaattgctttctagaagttagacgaatgaggaaataaaaccttacaaaaaaatttcaaaaatttagaaaaataaaaaggtcagattttactctgaccttttaaatattctgatttaaaacttacattgacgttgtgaatgtacgtgtaattacatcttgttgttggtctttagttaaagagttgaaacgtactgcgtaacctgatacacgaatggttaattgcgggtatttgtctggattttctaccgcatctaataacatttctcgatttagtacattcacgtttaagtgttgaccgccttcaatagttgtttcatgatggaaatatccatccattaaacctgccaaattgcgtttttgtgcatcaatatctttacctaacgcattaggtacgatagagaacgtataagaaataccgtctttagcataagcaaatggaagtttagcaacagaagttaatgatgctaccgcacctttttgatcacgtccgtgcattgggtttgctcccggtccaaatggtgcacctgaacgacgaccatcaggtgtgttacctgttttcttgccatataccacatttgaagtaatcgttaaaacagattgagttggtgttgcattgcggtaagttttgagtttttgaattttcttcatgaaacgttcaaccaagtcaactgcaatatcatctactcgtgaatcgttgttaccaaattgtggatattcaccttcaatttcaaagtcaatcgcaacattttttgaaataccgatcacgtcgccagctttatttttcacttcaatatcaccacgaataggttttactttagcgtatttaattgcagaaagtgagtcggcggcaacagaaagaccggcaataccgcaagccattgttctgaatacatcacgatcatgcaatgccattaacgctgcttcataagcatatttatcgtgcataaaatgaataatgttcaatgcagtgacgtattgttttgctaaccaatccataaagctgtctaaacgggtcatgacgtcttcataatctaaatattcagttgtaataggatcagttttagggccaacttggtcaccggatttttcatcaataccgccgttgatcgcatacagtaatgtttttgctaagttcgcacgagccccgaagaattgcatcattttacccacgatcattgggcttacgcagcaggcgattgcatagtcatcattttggaaatccggacgcattaggtcgtcattttcgtactgtacagatgaagtatcaattgatactttcgcagcatagcgtttgaaaccatcaggtaaactttcagaccaaagaatagttaagttcggttctggtgaaggtcccatcgtgtaaagtgtatgcaagatacggaaacttgttttggtgactaaagtacgaccatctaaccccataccggctaaagtttcagttgcccacattggatcaccggagaataattgatcgtattcaggcgtgcgtaagaagcgaaccatacgaagtttcatgaccaagtggtcaattaattcttgagcttcttgttctgtaattttgcctgctttgagatcacgttcaatgaaaatatctaagaatgtggatacacgaccaaaagacattgccgcaccgttttgtgatttaacggcagcaaggtaagcgaagtaagtccattgaaccgcctcttgagcattttttgctggagcggaaatatcatagccgtaagatgctgccatttctttcattttgcctaaagcacggtgctgttcagcgatttcctcacgtaattgaatcgttgcttgaatatcttcgccactttctaatttctcttgtaatgaagtaaattgtttgaatttatctttcattaagaaatctgcaccataaagtgccatacggcgatagtcaccgatgatacgaccacgaccgtaagcatcaggtaaacctgtgattacacctgatttacgacaacgtaaaatatctggtgtataaacatcgaatacgccttgattgtgagttttgcgatattcagtaaagattttttcaacttctggattgagttcacgacggtaaactttacatgagcctctaaccatgttgatcccaccaaacggcataattgcacgttttaagggggcgtctgtttgtaaaccgacaattttttctaaatctttattgatatagcccgctttatgagaagtgatagtggatggaatatctgtgtcaatatcataaggttcgtgagttttgttctccactttgattttttccattacatcagcccacagaattgatgttgcttctgttgcttccgctaagaatgcttcatcaccctcgtaaggcgtatagtttttttggataaaatcacgaacatttacttcagtttgccaatctccaccgacaaaaccttcccaagctttttgttgagtttctgttaattgagccatcgctaataacttccttttgagtaaataaaaataaaactgttgaactttgtaaaaacaatcgaaaaacagaccgctcttacaccctaatgatttattagtgtctatgaggtttattggtaaaccattgcattaatgcaatacaaacaccaccgccgataatatttcctaaggtaacaggaattaaattcttaaagataaaatggtaaatatccaaatcggcaaattgcagaggattaagattaattgcttgccaaaaatctgttgagctggcatgtgaggtaattattcccattgggatcataaacatatttgcaacactatgctcaaagcctgaggcaacaaatagacctataggcaaaatcatgatgaatgctttatctgttaatgtttttccggcataactcatccaaacagcaatacataccataatgttacatagaatacctaagcaaaatgcttcaagccatgtgtggtgaattttatgttgtgctgtttttagaatggttaaaccccattgtccatttgctgccatagtttgaccggcaaaccaaattagcaatacgataattaatgaaccgacgaaattacccaaataaacaacaagccaattttttagcatttgagttgtggtaattcgtttattcacacgtgcaataagagacatagttgatgatgtgaaaagctctgaaccgcatactaccgccatgataataccaagagaaaaaaccagtccgccgaccagcttggtcagtccccagggtgcattacctaaatctgtttgagtagtcgtatagaaaacaaaagcgagagcgataaatgcccccgcagaaattgcagataagaaagaatagcattgatttttagttgctttatagacacctacattctcaccgatttgtgccatttcttgaggtgatgccactgtggttgtactttcggttttcattactaaccctattaaaattaaactggcgttattctaagtcattaaccggaaactttaaactaaaaaattttttattttttataaaatttgttaaatgaaattatttttaacaagtttttaacatttagttgttttacatttattaaatgcaacaatttattaacattagcaatctaaattgctatttaaagggatttctgatacaaaatgcacctattatttttatatcatgggagaacaaaaatggtagaagaaactatttttagcaaaattattcgtaaagaaattccggcaaatattgtttatcaggatgaattggttactgcatttcgtgatatatccccacaagcacctacccatattttaattattccaaataaaattattccgacagttaatgatgtaacatcagaagatgaagtaacgttgggacgtttatttaccgtagcggcgaaacttgctgaaaaagagggaatagcacaagacggttatcgtttaatcgtcaactgtaataagcatggaggacaagaggtttatcacttgcatatgcacttggttggcggtgagcatttaggcaaaatgttggcaaaataatgaaaaatttacttatcgcttttattttgagtttgggattaattgcttgtggttctttggaaaaagtaaatttagtgcattctcaacaaccaattataaatattagtaccgagcttgcttctgatattgacgtacaagtcagccattcatcagcatcgctgacaaacgtttcacaaaagcaagtgacgctcgtatattattttttttggtacgataaaaatggtgtaacacaaggtgatgtgactaatatgaaaaatgccactatgctgattttatcgccaggtcaaacacgtcagttagtattacaaaagccgacaacagaaagtgtgaattaccgcctttacttgagtttatagaacaaaatgtcgatattattaatagatttatcgggtcaagagttacgtcaagaagaaatcgaattacttgaacatcctctagtcgcaggattaattttatttagccgcaatttttatgatattgagcaaatccgacatctcattagatctgtgcgtcaaaaggttaaaaagcctttattaattactgttgatcaagagggtgggcgagtacagcgttttcgtcagggtcttacgcaattaccggcaatgcagtcctttgcctgtttactttctgaccctcaagagcaacaggaaatggcttggcgagcaggttggcaaatggcggcggaaatgaccgcacttgatatcgatcttagctttgcacctgttttggatcttgggcatcaatgtaaggcaatcggcgaccgcagttttcattatgaggaaaagaaactgattgaacttgctgagaaatttattcaagggatgagacaaatcggaatgtcggcaacgggtaagcattttcccggtcatggacatgtgttagccgattctcatttggaaacaccttatgatgatcgagcaaaagaattaatttttgcacaagatattcgaccgtttcagtctttgattaaacaagggttgttagatgcagtgatgccggcacatgttatctacactcaatgtgataatcaaccagcaagtggatcgtcttattggctaaaggaggttttacgtcaacaattgggattccaaggagcgattttttctgatgatttgggtatgaaaggtgccggttttatgggggattttgttgctcgttgtacgcaatctcttcaggcgggttgtgatttattgttgttatgtaacgagcctgaagcagtggtgcaagttttagatcgttttaaaccacaggaaagtcaaaataaacgaataatacgccaaactagattgaataaattattcaaaaaacaacggattgattggcaaaccttacgcactcaacgtgattggttggaaaatcacaaaaaacttaccgcacttcagcaagattggttagcctataaggggtaggacaattagaaattatggaggtggttttttgagagtatacaaaaataaagaagaactcaaaactgaaataaataaagcatttaagaagtatattttagaatttgataatattccagaaaccttaaaagataagagagttgataaagttgatagaactccagctgaaaatcttgcttatcaagtgggatggacaagtttggttcttaaatgggaaaaagatgaaagaaaggggcttcaagtaaaaacaccatcggatgaatttaagtggaatcaacttggtcaattatatcagtggttcacggatacttatgctcatttatccttgcaagagttaaaagcaaaattaaatgaaaatattaatgctatatgtacaatgattgattcgttgagcgaggaagaattatttgaaccgcatatgagaaagtgggctgatgaagcgactaaaacagcgacttgggaagtgtataagtttattcatgtcaatacggttgcaccttttgggacttttagaacaaaagtcagaaaatggaagaagacagcattataaattacctttttacaaaaaaatttcataaaaatagttaccaaaggcaatagagaaaactatcgtctttctctttgcaaatttaaattttattaaattaatatgaatttaattcatgaaaagtataatttttctgaaattgacacatattttctttctctttatgatgattttaaccgatttaaagataaatttattatggagtaaatgaatatgagttataccaaagaattagatacattaaatcaccatatggttgatattaatgggaaaattaatgtttcttttgagttttttccacctaaaaatgaaaaaatggaaactcttttgtgggactctattcatcgtttaaaagtccttaagccgaaatttgtatcagtaacctatggagcaaattccggtgagcgggatcgtactcataccgttgttaagcgtattaaacaagaaaccggtctggaagcagcaccgcatttaaccggtattgatgccactccggaagaattaaaggctattgctaaggattattgggatgggggtattcgtcgaattgttgctttacggggtgacgaacctaaaggttatattaagaaacctttttatgcctccgatttagttgagttattacgttcggtagctgactttgatatttcagtggcggcttatcctgaagtgcatcccgaagcaaaatccgctcaagcggatttaattaatttaaagcgaaaaatagatgcaggagcaaatcttgtaatcactcaattcttttttgatgttgatagttacttacgttttcgtgatcgttgtgcctcaatagggattgatgcggaaattgtaccaggcattttaccggtaacgaattttaaacaattacaaaaaatggctgcgattacaaatgtcaaaattcctagttggatggcgaaaatgtatgaagggttagatgatgatcaaactacaagaaatttagttgcggcaagtattgcgatggatatggtaaaggttttatcttgtgagggggtaaaagatttccatttctatacactcaatcgcagtgagttaagttatgctatttgccatactttaggcgttcgtccaagtttataaaaaaccgcactttgagcctaaaaaaggactaaattgttaaaatttggtccttttatttttacggattttattaagaaatgcacaatttaaaatggaatgtcatcatcaagtggagcatcaacaggtgatggagatgcaatgctcggtttaggttgagaatgtgattggtaggttggttgctgttgaggttcgtatcctcccatttgtccacgatctgaacgactatccagcatttgcaatacatcgccctgaatttcagtggtataacgatcttgaccattttgatcttgccatttgcgtgttcttaaacgtccttctacataaacctttgagcctttacgtaaatattctccagccacttctgcttgacgacgataaaacacgatgcgatgccattctgtaatttcacggcgttcattggtatttttatcaatccaactttcacttgttgcaacactgatattcgcaacagcatcaccgtttggcatggtgcgaatttcaggagcgttaccaagatttccaacaatgattactttatttactccagccataagtcctctaatttgcttcagttaaaaagtgcggttattttgccttaaattaaaaaaaaaagctatgcttaaaatgaactaaactggatatttgcacagttgtttaggaatgtgagataatgatcgcaaaatttacttgattggcttgctattattgtcaatttattattggtgtattatggaaaaaattgatattcgtggggcaagaactcacaatctaaaaaatataagtttaacaattcctcgtaacaaacttgttgtaattacggggctgtctggttcaggaaagtcttctttggcttttgatacgttatatgcagaggggcaacgccgttatgtagagtcattgtctgcctacgctcgccaatttttatctttaatggaaaaacccgatgttgatcatattgaaggattatctccggctatttctattgaacaaaaatccacttctcataatcctcgctcaacagtgggaacgattactgaaattcatgattatttgcgtttattgtttgctcgagtaggtgagccgagatgcccagaacatcatgttacattaagcgtgcaaactattagccaaatggttgataaagtactgagtttgccggaagaaagtaagattatgttacttgcaccggtggtcaaaaatcgtaaaggcgagcatatcaaaattttagaaaatattgccgcacaaggctatattcgggcaaggattgatggtgaaatttgcgatttatcggatccgcctaaattagaattacagaaaaaacatacaattgaagtggtggttgatcgctttaaagtgcggtctgatttggctactcgtttggctgaatcttttgaaacagcgttagagttgtccggtgggacagcaatcgttgcggatatggagaattcgcaagtggaagaattgattttttccgctaattttgcttgccctcattgtggttattctatccctgaattagagccgaggttgttttcttttaataatcctgccggtgcttgttctacttgtgacggtttaggcgtgcaacaatattttgatgaaaaacgtgttgtacaaaacgcatcgatttctttagccggtggagcgataaaagggtgggatcggcgtaatttttattattaccaaatgttgatgtctttagctaagcactatgattttgatattgaactaccttttgaaaagttaccgaaaaaaattcagcaaattatcttaaacggttcaggtgacgaggaaattgaatttcaatatatgaacgatcgtggtgatgttgttcttcgccatcatagttttgaggggattctcaataatatggctcgccgttataaagaaaccgaatctatgtctgtacgagaggaattgtccaaaaatattagtagtcgaccttgtgtagattgttgcggttcgagattacgttcggaagctcgccatgtttatatcggtgaagctaatttacctgatgtatcagagaaaagtatcggagaagcactcaattttattgataacctgacattgacgggacaacgtggacaaattgcagacaaaattctgaaagagattaaagagcggttacaatttttagtgaatgtggggctgagttatttatctttatctcgttcagcggaaactttatccggtggagaagcacagcgtattcgtttggcaagtcaaattggtgcaggattagttggagtaatgtatgtacttgatgaaccctcaatcggtttacaccaacgagataatgagcgtttattaaatactttgttgcatttgcgtaatctaggcaacacagtgattgtggttgaacatgatgaagatgctatcatggcagctgatcatattattgatattggtcccggagccggtgtgcatggaggaaatgttgttgcacaaggtaatgcacaagaaattatggctaatccaaattctttaacaggtaacttcttgtcaggtaaggaaaaaattgaaattccgctgaaacgaaccgcagttgataagcaaaaaatgcttagattaaaaggagcaagcggtaataacctgaaacaggtgaatttggatattcccgttggtttatttacctgtgtaacaggtgtatccggttcgggaaaatctactttaatcaatgatactttatttccattggctcaaaatgcgttaaatcgtgcggaaaattcccagtttgcaccttatcaatcaattgagggacttgagttttttgacaaagtgatcgatatagatcaaagtccgataggtagaacgcctcgttccaatcctgcaacctatacagggttatttacgccaattcgtgagttattttccggcgtgccggaggctcgagcgagaggttataatccggggagattcagttttaatgtgcgtggcggacgttgtgaagcctgtcaaggtgatggcgttatcaaggttgaaatgcactttttacctgatgtttatgtgccttgtgatcaatgtaaaggtaagcgttataatcgagaaacgttggaaattcgttacaaaggcaaaactatccatcaagtgcttgatatgacagtagaagaagcacgagtgttttttgatgctattccaatggtagctcgtaaattacaaacgttgattgatgttggtttatcctatattcgtttaggtcaatcttcgacaaccttgtccggcggagaggctcaaagagttaaattagcaacagagctttctaaacgagatacagggaagacgttatacattttagatgaaccgactacaggattacattttgccgatattaaacaactcctgaccgtcttacattgtttacgtgataagggaaataccatagtggtaattgaacataatctcgatgtaataaaaaccgctgactggatcgttgatttaggaccggaagggggaaatggtggaggacaaattattgctaccggcacgccggaagaggtttgcctagttgaaggatctcatacggcgagatttttaaaaactatgttggctaaaaaataacatcataaattagaaaccgtacttcatggattcgattttaataaagtgcggttttttctttgctttttataaaaaagttctgttacaaagggtgtttttttgctaaatttagcacaattttttcgttaagctcggtagagcgtttttatacaatttattagcggacttcttatgttattcaaaaaaattcgtggtttattttccaatgatctctcaatcgatcttggtacggcaaatacgttaatttatgtaaaaggtcaaggtattgttttggatgagccttcagttgttgcaattcgcaaggatagagcaggttcacttaaaagtattgcggcggtcggaaaagaggctaaattaatgttgggtcgtacgccaaaaagtattgaagctattcgtccaatgaaagatggtgtcattgctgatttttttgtcacagaaaaaatgttgcaatactttatcaaacaagttcacagtggcaattttatgcgaccgagtcctcgagtgttggtttgtgttcctgctggagcaacacaagtcgaacgtagagctattcgtgagtcagcaattggtgcgggagcaagagaggtttacttaattgaggagccaatggcagcagctattggtgcgaaattacccgtttcaacggcaacaggatcgatggttattgatattggtggtggtacaacagaagttgcagtgatttctttaaatggtattgtttattcttcttctgtgcgtattggtggtgatcgctttgatgaagctattatcgcttatgttcgccgcacttttggttcaattattggagaaccaacagcagaacgtattaaacaggaaataggtattgcttatattcaaaatgatgatgaagtgaaagaaatggaggttcatgggcataatttagcagagggagccccacgcacatttagcttaacttcaaaagatgttttagaagcattacaacaacctttaaatggcattgtgaccgctgtacgtacagcgttagaggaatgccaaccggaacatgcggcagatatttttgagcgtggtattgtattgacgggtggtggagctttattgcgtaatattgatgtattgctttcaaaagaaaccggtgttccggtaattgttgcagatgatccattaacttgtgtcgctagaggtggtggtgaggctttagatatgattgatatgcacggcggcgatattttcagtgatgaaatctagttttaacaacatgaaaagtgcggtagattttaccgcactttttgtcttaactatttaatctgttgtgataaatcaatctttatgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggatggtgtatcggaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccactaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtgcgtgtaattgccagtggaacagggcgaagtgatgaattgactttagagaatgtgccgagatcggtcgatattgtaaaaggtgatttacttgttacgtctggacttggggggcgttttttagaaggttatcccgtcgcaattgtggaaaatatttctcgtgatagcaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctacatataaggtgaaaaagactccggtacaggaggaattttttccatctaataatacagatgagtattcagtagatatattagaaaccttaccggaaaatttacctgagcaagagtttctacaaaaagagcagggggatgaaaattaatgaaagtaaaatttttgttacaaattttagtgatcagcggtttgtttatttttacttttgctcttgaacttatgccttggccagtaacttttcagagtttcaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattcttactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatagttttgttcttgcgaggattaagtaatcacatgccaataatcacacaatttccaatggagttgactttttctaaagttgtttttgttgtgttatgatctccaatgggaccaatgacaactctgttccagttttcactacgtttaattttagcatcgaaaccggcaatagataaacgtgcttgcatgttttctgcttgagcacgatttttaaaagccccacattgcaagccaaatttcttttctggcgaatttacagtagggttgttttgtatagactgtgctgtttgtaccggctttgcggacacaatatctattttctcacgtcctttatcttctttaattcttgcccgttcagccgctttttgctctttttccatttccagcaaaattttcttttgctcttcgcttaaacgaatatcgttatttaacgattgattattatcaacaggaactgttcttgtttctagggctttaatgtaactccatacttcttccggtggggtagggaggacgcttttgggtttttcagattttacgggtacctgtatagttgtattcttcgttttggttttcaaaaaatacaacccagccacaaagccaataatgatcaaaagaatcaaggtaattaagaagattttatgctttccttttgtctgttttttctttttagacttcacacctgttccgtaatcttttgccacaataaaatcctgaataacgaataagtaataaaaatggcaattctactcaaaaaactataactaatctagtactagctcaaatccagcggatctatatctaaaactaaccgcacttgttgtaatcttaaaaaattttcttgctgaaaagagtgtaaaatttgttgtaattctgctttggatttatgttgtaataaaaggtgccagcgatattgccccgcttttttgctaaaaggtgcttggataggccccaagatttgcaagtttttgcttgaggtattatgaaaataggcggcaatttggtgtaacacttcctcagctttttgtgagtggcgactttgggctttaaacagtgcttgagcactgaaaggcggtaaccccatttggttacgcaaagtgagggcttgttgggcaaagtaaggataaccttgacttaataaactaaccaataaaggatgttctggatagtgggtttgcaagacgacctctccttgtttttcttctcgtccggctcgtcctgcaacttgaacataaagttgggctaaacgttcttctgcccgaaaatcagtagaaaaaagtgcactatccacgtttaacagtgccactaaagttacattggggaaatgatgccctttggctagcatttgtgtaccaattaaaatttggctttttcctaattgaatatcccgtagatattgttccaattttcctttgcgagcggtactatctctgtcaatacgggtaatcttatagtttggaaaacgttggtttaaactttcttccaattgttctgttcctaaacctgtcgtcactaaatgtgtcgaaccgcaatttacacattgcattggaataggtttttgtgttccgcaatggtggcaacgtagaactcgctgatgttgatgataagtataaggcttttcacaatgttggcattctacaatccagccacattcatgacaaagtagaacaggtgcgaaaccacggcggtttaagaacaataaaacctgatttcccttttttaagtgatttttcatcattgtcaacaaggtttcagataaaccgttatgtactatttgtcgctttaggtcgataaccgaatgacgaagtgcggtagtattttttgctctttttttgagtgtgatgtgacgatatttgccttgtcgcacattattgatgctttccaaacttggcgttgcagatcctaacacgataggaatatccaattgtttagcgtaaactactgcaagatcacgagcatgataacgccagttatcttgttgtttaaatgaaagatcatgttcttcatcaacgataattagccccagttgtttaaagggagtaaatagtgctgatctcgtgccgatgatgaccgcactttcgccatttttagaacgttgccatactttcaaacgttggttatcatttaaatttgaatgtaacacatcaatttcaatattaaatctcgcttgaaagcgttgtactgtttgtggcgtgagaccaatttccgataccagtactaaaatttgtttctcttgttgtaaaatttcctcaataaattgaagatagatttctgtttttcctgaaccggttacgccttctaataaccaacagataaatccggattgaaagattaattggctgagtgcaagagcttgctcttggttaagaggaagacgatcgttagtttttacaatagattgatgatttaatttttgttgccaagagatacttgttttatgtatttcttgttcagatatataccccttactttttaaggtgctccaaacttggttatgaaaaggattgttatttttttctgtgatatttttttgtagataatgtagagcctcaagctgtttttttgctctttttaacttgttgttgtctaatgcttgttgcccctgttccgttagttgaaagaaaaatgttgatttttctaccgcactttcaccacggcgtaatttgcttggcaagctgcttattaatacttctcctaagggaaattgataatagtccgctccccaatgtagtagacgccataattcaggggtaaaaacagaatgatgatcaagaacggagataatgggtttgagttgtgaaatatctatctccgttttttcaggtaactcagtgacaataccaattaatttttgtcgtccgaaagggactaatactcgacagccgacagcggttgaaagggcatttggaataagataatcaaaaaaactaaacagaggaacggcaagagcaactcgtgcaagtttcattatgttattttccttgcgtagtttgtgtgatttcatctcgtttaacttcatccccaaaaatatccatttcagctaaagaggtattttcaaaggttttgtttacttcacgcaatttttgctcgacagcacgaaaacggcgttcaaattttttattggctttacgcaagctttcttcaggattacattttagatgacgacttaaatttactaccgcaaaaagaagatcgccgatttcttcttcaatttttgtttggttgataggatttgtttgatattcctgtttaacttcttctaattcctcttgtactttagctatcacaggattgacattattccagtcaaaacctattttggcacagcgtttttgtaatttttcggcacgcttcaatgctggaaaagcatggggaatattatctaagattgattgatatcctttttgaatatattcacttgcttttgctttgttccaattttctaatgcctcgtctgcattattagctttatgctcaccaaacacatgaggatggcgacgcaagattttttctgtaacggcatgtaccacgtcatcaaaagtaaaatattgatcttccgtagcaagttggctaaaaaatacaacttgtaagagcaaatcacctaattcttctttcagatcagacatgttattttgctctattgcttcaatgacctcataagtttcttcaattaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacagaaaaatgaaaaattttttaaatttttagccacactgtcccaggaaatgacgatgaactatcatttgataaatatattgggtcgatgagtgcatctattatgtgatgagtgcaccaagactgacaagcatttttttgaatcaaatattaaaaaattatgctcatttctaaaaaaacattttaacatcttgatgtttttagtttacaagaaaagagccatagattaacgaggcatttggtttatggagctgacttttattttttattttattcacataaggaaggtattatgttaaagaaattagacccaagtaaagttgttggacttaaaaaccaatcgaactgcaaaacaattatgacaattggtgttcaagacaagaaataactccagttgagaagacactaggttgcaatctagtgtctttttttattaattagattttaaggataatgaatgaactttaatgatatttataatccaaaccagtctttggcgattgcgttgcatagtgcaaataaccaaaagattgtagattctttttattatttattggatgtgtgtgatgaaatcttggatgtaaactccaaagaaaatataataaaaggcatagattttataaaatccaattcgatattgagaggtattttatttcaatttgttaatcatcttgttaagtcaatttctaaaaatgatattgatgaaataaaagatgtatttacttattttaataattttatcttattttatagccgagaaaaaataattttttctagtgtaggaaatataggtaacttatatctaaatcagtttaataaaattaatgatgatgcctatgagttttcttgtacacctatcaaggataatttaattaatgaatataggttaaaaattaataatcttatgaaatttatcagagatattgatttagaaacctatatggaaattgagaatatagtcgatgatatatatgtatttggtgtgaattttaaagatagtcaagaaatgatttattctggtagtgattttgccaaacttggttgtattttctttaatgaagatatttttttagataaagatgatttgtttatcttggataagattatacatgaatccgctcatcagatattattgtctgtaatgatacatgatgaagttgtgctaaattcagatgatgagcgttatccatcacctcttagaaccggactaagaacaatgaatggtatatatcatgcagcttttgttttgtatcggatagcaagatcaagattttttaatcaaattattgagagaaaaaatactcaatatccttataatcatttgatttcttattttaacaaaaataaagaacaatttttggtttgttatgatgttatttctaaaaatggaaaattaacagatttaggaaacgttatcatcgaaaactgttataaagaattaaggagtatgtctagtgaaattgacagataagctatctaaaaaaaccattgaattgatgcaaagatttaatgataatgcggtaagaagactaaatgatgatttatatccaatagcaccagatttggtcgaaatgcttattgattcaatttacggtaatgtttatcaaagaggtgttttgagtattaaagaaagacatatagcaacgctatcggcacttattgccattgggggctcagaaaggcaattgtcgtttcaagggtttgctgcttataagcttggtatcacaaaagaagaaatccaagaaatattgatacaaaatgcaatatttagtggatttacgagagcgatgaatgcggctgttgtgcttgatgaagtgtataagaaatatttacaagggaaagatgatgaagcataatgatttttatcgttatcaattagcagaagttatgcttaatactggcataagaactattggatttttgtttgcttggcttatgcttactacctttcatcaacctcagcatttaggcgtttttattggtatttcttgggcgtgtcaggtgttggcattgcttttattttcttgggtgtgcaaccagtctacatttattatttatagtaaaaagttattgttgcctttttgctttatttgttttttgttttttttggcattgtgttttgttcataattattttgtttttggcatagtttttatcgttagttctgtttttaccattctcttgaatccattggggacgagtcttaccaatgatttgtatgatggtgaagataaatcaaatggatttaaattgcgtggttttgtgaattctattaataccattatttcccctgctatttccggatttattattcactattttaatacacagaagattattgttttttgtatcctattatctttattaagtggtttcttattttattttataaaaaatataaaattacaagaaaacttgggaaaaaaatctaaaaacacccttaaaatactattgaaaaaccctattgaaaaattgatggtttgtgtatcattattagctaattttattatcactcctattatttcatatattattccttacaatatatccaacaaatttaatttatcggcattttatatcggtattagtgaggctttctttggtatcggtatgataataggtagtgtttattttctaaaattgtttaataaaaaacttggcagtcatcatagtttggtattaagtatttttttagtgatgataggtattttgttttctgtgacagataatttttatattttttgtttttctttaatgacgattggggttggcgttgtgatgtttaatattaacagtacacatattcgctgtacggcaactcccaaaaatattcgtaccagttttgaatttgtttttttagcgtgctgtattgtatttattcctattggcgtattgttaacgacttgggtattaaataatggagctttggtttatttttatggaattatttgtttgattatgttgattttgtctttaatgatttttaaaaatactgatattgttcacattcatcagcttactgatgataagctagatggttattatcaggttttgtatcccaaaatttatccataggtgtgggtgttgtggtatttggattgtggcactgccctagcaggggcggaggtagagtatcaagacaaacaagtaatcatggaacgataattttgctttaaattccaaggacaaccattattaggatctcgtaattgggcaatgatacgaataaaatcttgaatgtggtagttcataaataatctcatgaaataaatagtatctgaaataaggatatcatagccttgaatgaacaaaaaaatgaaaaattttttaaaacgtgatctggtgcaaatttttttatttttatcaatgctagtatagttccaacagttagttaaattcattaagctaaggaggcaattatgtataaacacgtattagtggctgtagatctttcagatgaaagtggatttttactcgaaaaggcagcaaaaatagcgaaacaatatggtgctaaattatcggttatccatgttgatgtgaatttttcagatctttatacgggtttaattgatgttaatatgtcttcaatccaagatagaatttcaactgaaacacatcaagccttgattgagttatcagaacaatctacctatcctgtttctgagaaattgagtggtagtggtgatttaggacaagtcttatctgatgctgttgagcaatatcaggttgatttattagtaacaggtcatcatcaagatttttggagtaagttaatgtcttccactcgtcaagtgatgaattcaattaaagttgatatgttagttgtaccgcttagagaagaataaatataaagaatttgtgatgggcagcgtgagttgcccttttttattagcattgaaatattgttttgcataatgcgttattacttcttgagagaatatgaataatcagctaaaaaagttttttataaatgtcaaaaatatgcaacaataagcaggttttttactggatttacaagatataacaaggttttttaatgaaaacaacagcagaaattagacaggcttttttggattttttccatagcaaaggacatcaaattgtagatagcagctctcttgtaccggaaaatgatccaacgttactttttactaatgcgggaatgaatcaatttaaggatgtttttcttggattggatacccgttcttatacgagagcaactacagcacagcgttgtgtacgtgcaggcggtaaacataatgacttagaaaatgtcggttataccgctcgtcatcatacttttttcgaaatgcttggtaattttagttttggagattatttcaaacaagatgctattaaatttgcttgggaatttttaacttcaccagaatggctcggattaccagaagaaaaactatatgttactgtttatgaaactgatgatgaggcctatggtatttggcataaaggagttggtgtgccggaaaatcatattattcgcattggtgataataaaggtgccccttatgcttctgataacttttgggcgatgggtgatacaggaccttgcggtccttgcactgaaattttttacgatcatggtgagcatgtgtggggcggtttaccaggtagtgaggaagaagatggtgatcgttatattgaggtttggaatattgtatttatgcaattcaatcgattggctgacggcacgatggaaaaattaccaaaaccttccgttgatacggggatggggttagaacgcattagtgcggtaatacagcatgtaaattcaaactatgatattgatattttccaaaaattaattgctaaggttgcagaactgacaggggaaaaagatttaactaacaaatcgttgcgtgttatagctgatcatattcgttcttgtgcctatttaattgtagatggtgttattccttctaatgaaggacgtggatatgttttacgtcgcattatccgtcgtgcggttcgtcacggacatttattaggtgctaaagacactttcttttataagctcgtaccggttttgatcgatgttatggctacagccggtaaagatgtaaaagcgaagcaagccaatgtagagaaactgctacgattagaggaagagcaatttgctcgtactttagagcgtggtttagccttgttagatgaggctttaattaacgtaaaagatggtgtgttatccggtgaagtagcatttaaattatatgatacttacggttttccattagatttaactgccgatgtttgccgtgagcgtaatattcgtattgatgaggaaggcttcgagcgtgaaatggaagtgcaacgcttgcgtgcacaggcggcaagccgatttggtgtagattacaataatgttattcgtgtagaagggacaactacttttgaaggttatactgaggctgaaactcaggcaaaagttaccgcacttttctatgaaggcaaatccgttgagagtattagtgcagggcaaagtgcggttgttattttagatgatacaccgttttatgctgagtccggcggacaaataggtgatagaggttgcctgattgcgacaaatatgcggtttgacgtgaaagatacgcaaaaatatgggcaagtttttggtcatatcggtacgttaattcaaggcacattaaacgttggtcaaacaatcaatgctgttgttgatacggaacatcgtataaaaacttcattaaatcatagtgctacgcatttattacatgcggctttacgtcaagtattaggttctcatgttgcacaaaaaggctctctcgtatcagatacaatattacgttttgactttgctcaacctgaagcgattagccaagaacaattgtttgaaattgaatgcctcgtaaatcagcatattcgagctaatcatttggtagtaaccgaagttatgcctattgatgaagcgaaagctaagggggctatggcattatttggtgaaaaatatggtgatgtagtgcgtgttgtgaaaatgggcgagttttctattgagctttgtggcggtattcatgtaaaacgtacgggtgaaattggtctatttaagattgtttccggatctgctattgcggccggagttcgacgtgttgaggctgtcactggagagggagcaatcaattggctgcaacaacagcaggtactattgatgcaaagtgcggatcttttgaagtctgatgcaaattcattagtcgaaaaaattcagcaattacaagataaagcgaagaaaacagaaaaagagttgcaagcactaaaagaaaaatctgcgatgaaggcgggttccgatattgctaaaagtgcggtagaaattaatggtgtttctgttattgttcaacagcttgaaaatatggatgtaaaatctttacgtgttattgtcgatgatttgaaaaatcagttgggatcagcggtaattgcttttgttacgaagaacgaagataaggttaatctagttgttggcgtgacaacggatttaacctctaaagttaaagcaggcgaattagttaatttaatggcacagcaagtgggtggtaaaggtggcggacgtcctgatatggcaatggcgggtggatcacagccggaaaatatctccaaggcgttaacagtttgtaacgaatggttacataaaaatttataaagtaaaaattttgtgttgtggctcacatttttgaatattattcatctctttgtgggaataaataacgtacaatgtaagtcggataacacttcattattatcatgctttattattataacgctttgttatttaaggattttaagcaagatagagatcttataaattcaactgaaatgagagggttatatgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaattggctttttgaacgataagatatggagaaattatgagtaaactaacttgttttaaagcatatgatattcgaggtcgtttgggtgatgaattgaacgtggatattgtatatcgtattggtcgtgcatttggacaatttttaaaacccaaaacgattgttgtcggtggtgatgttcgtttaacaagtaaagaattaaaaagtgctgtaacaaatggtcttttggactcaggtgttaatgttattgatttgggagagacgggcactgaagaggtctattttgcgacttcattcttaaaagctgatggtggtattgaagtaacagccagtcataatcctatggattacaatggattgaaacttgtacgtgaaggttcgcgtccgattagtgcagatacaggtcttgcagatattcaacgtcttgcggaagaaaataattttgctccagtttcccaacgtggggagtataaacaactttcagtattagggcattatattgagcatctcttatcttacattaatttggaaaatttaaagccaatgaaattggtgattaattcaggcaatggtgcagcaggtcatgttattgatgctattgaagcacaattccgagctaagcatgtgcctgttgaatttgtgaaagttcacaataatccggatggtactttcccgaatggaattcctaatccgattttgcatgaaaaccgtcaagatacgattgatgccgtgttagagcataaagctgatatggggattgcttttgatggcgactttgaccgctgtttcctatttgatgaagagggcggttttattgaaggttattatattgtgggattattggcacaagcatttttacagaaaaataaaggggctaagataatttatgatccacgcttaatttggaatacgattaagttagttgaagataatggcggcgaagcggttatgtctaaatctggacattctttcatcaaagaaaaaatgcgtactgttgatgctatctatgggggtgaaatgagtgcacaccattatttccgtgattttttctattgtgatagcggaatgattccttggttgcttgttatggagttagtgtcaaccacaggtaaatcactaggtgagttagtggggaatagtcttgaaacctatccatcaccgggtgaaattaacagtaagttagttgatgcgaagtctgcaatagagcgtgtgcgtgttgcttatgaaaaagaggcagtcagtgtagatgaaactgatggtatcagcattgagtatccaaattggcgttttaatttacgcagttcaaatacggagccggttgttcgtttgaatttagaaacacgaggcgataaacaattgatgacagaaaaaacagaagaaattctcgctttattgcgtcaataaattaaacttaagtgaggccacactttgtttccgcaaagtgcggttatttatggctctaattaaggaaattaaaatgaaagtaattattcctgttgccggcttaggaacgcgtatgttgccggcaactaaagcaattcccaaggaaatgttaacgttggttgacaaaccgttaattcagtatgtcgttaatgaatgtgttaatgcagggattaaagagattgtgctggtaacgcattcttccaaaaatgccatagaaaatcattttgatacatcttttgagttagaaactatgttggaacagcgtgttaaacgccagcttttagatgaagttcgttctatttgtccgacaggcgttactattatgcatgttcgtcaagggaatgctaagggactagggcatgctgtactttgcgggcgagcaattgttggcaaggaagcttttgccgttgttttacctgatgtattacttgctgaatttgatagtaatcaaaaaacagaaaatcttgctgcaatgctgaagcgttttaaagaaacgggaaatagtcagataatggtttcacctgtacctgataaagatattagtagttatggtattgttgattgtggcggtgttactttaaatgttggtgagagtgttaaaatctcaaatattattgagaaaccctcatttgaggacgcaccttccaatttgtctgttgttgggcgttatgttttttcagcgacaatttgggatctattggaaaaaacgccagttggtgtcggtaatgaaatccaattgactgatgctatcggtatgctaattgaaaaagaaattgttgaagcatttcatatgaccggcaaggcttttgattgtggagataaaataggatatatgcaagcctttgtggaatatggtttacaacaccctcaattaggggagaattttaaaacctatttgaaacaactggtgcaggacttgtagaaattcgttatggctaaactttgtcggttctttaatataaaattttattaagggaccgattttttgtgattaaaaacagctatcaattcatttactttaattcttttgtgagatgatttgctaatagaacgctgaacttttaagcgtttaatttttgcgtctttgtagatctctctagtaaatttggtatcgtggttagagattaagaccggtacaccgtggtttagtgcggtatcttttgccagttgagctaaattttgttgatgagataaagaaaattcattgcctgagtagctggtaaagtttgagttttgtttcaatggtgcataaggcggatcacaataaataacagaatcattattgatcattgaaaatgcttgttggaaatcagcacaaataaacaccgctctttgtgctttttgggcaaaataacgtagttcagactccggaaaataatgtgttttataactaccgaatggaacattaaattcatttttagcattatatctgcataatccgttgaaaccatatctatttaagtacaaaaacaaaaccgcacgttcaaaaatattttgcgataaattaaattcagctctgcgatggtaataataattagcggtattagcttgatcatggaaaaatattggtttgcatgccgcaatataatgttcaacatcttgctttacaatattaaataaatggatcaagtccggattaatatctacgagaatatagtgttcaaaatgagtatttaagaatacagaaccagcaccgacgaaaggctcaataaggcaagttttatttttaggtaaaagtttgttaatttcctctgttaagcgaaacttaccgcctgcccattttaaaaatgggcgatatttcactaaattagaagaagttcctttgttggacatgaaagattaacttttttttgaacaggtacgaattgcatcaagcacgtattctttgtccgtatctgttgcaacgtaggcttgaccaagtgattttagtaagactaggcgtaattttccagcaagaacctttttatcacgcatcatatgtggtagataatcttcagctttcattgtatcaggcgaggctgtaggtaaatctgcttgagttaaaagtttctccagtctcgttacatcgttaagtgataaatcacctaatttattagacaagaccgcagctatcatcattccggttgcgactgcttctccatgtaaccaatttccatatccaaggtgagtttcgatagcatgcccgaaagtatgacctaaatttaataacgcacgctctcctttttcagtttcatcacgagtaaccacatctgctttaatttgacaacagcgagcaatgcactgctgtaaatattgttgttctaaagcaactaaattagttatatgtttttctagccatgtaaaaaattcatcatctaaaatagcaccatatttaatgacttcagctaaacctgcgtgaatttcccttttaggtaaagtagttagcgttagcgtatcaataataacggcacaaggttgataaaaagcaccgatcatgttttttcctaatttgtgattgacagccgtttttcccccaacggaagaatctacttgagcaagtaaagtggttggaatttgaataaaacggacaccacgttgatagcttgccgctgcatatccggcaatatcaccgatcacaccgccacccagtgcaataatagaggtatctcgtccatgattagcttttaaaagtgcggtaaaaattaagtctagagattctaaagttttgtattgttcaccttctgggagttgcacattctctaccgagcaaccaattttttctaaggtgtctgttatagaggataaataatactgtgcaactgtagggttagttacaatcatcaccttatcgcctttttttagcggataaacttgtggttcggataataaccccattccgatatggataggataactacgttcccttagttctacatttacacacagcattttatacctcaaaatgtaattagattttaagattatcaattaaatcaatgatttgattcgccattaatttggcactttgctcgtctgtcggcaaaataatatcagccacttcttcatataaagggttgcggactttggctaaatcttctaatacttggcgaggatcttcaacattttgtagtaatggacgttttttatcacgttgagtacgttggaattgtttttcaacggtcgtttctaaataaataacggtgccacgagcagataaataattacgattatcttttgatacgattgcaccaccaccggtagaaagcacaatgccttgtttttgagttagttcattgatgatacgttcttcgcgtttacgaaaaccttcttccccctcaacgtcaaaaatccagctaatatctgcacctgcacgttgttcaatttcggcatcagtatcaataaattccatgcctaaaatttgtgctaattgacgaccgattgtactttttccagcccccataggacccactaaaaaaatattacgtttttctgccatttgtacttcttctttacaaataaaattaaaaaattgatcttataaaaaacaaacgacctaaaataaagaggtcgtaaaagatcgcccaaaaataatggagattatctcaataaatgcccccttttttcaacctaaaaggggatttattttaagatttcattaagtgcggtttattttaatactattttaatggttttattatttcattaggttgttctgaacgaatgatccttggggtaacaaaaatgactaattcacgtttttggtgtctttcactttcacggctgaacagtctttttaatataggtatgtctcctaacagcggtactttatctactccttttgtgattgtatcgtgaaatacgccacccaacacaatcgtttccccatcttgtgcaaaaacttgagtattaatttcttgtttatcaatagataccatttcattttgcccataagtaatacgacttccaggggagttttggcttacaatgagatccagtaaaatagtattgtctttagaaatgtgtggcgttacttctaatcctaaaactgcttctctaaactctactttctgttcatcagatttcttgccggtaataacataaggaatttcagttccttgtttaatacttgcactttgcttattcgttgtaagtaaacgagggcttgcaataatttctacattattttctcgttcaagtgcggtaagttctaagtctaaaagtcgatcattaattttggcaatttgtaaagcaatagaacctgcaggtgttgcggtagtagcaaaattgacgttaagttgttccgttaaatgctgaaatccgtttgctgctagattgcctgaaagatgatgagcgttatttgtaggctcaaaaattccccaacgaacccccaattcttttaaattttcatcgctaattgttacaattctcgcttcaattgcaatttgttcaataggttgatccatttctttgattaatttttttaaggcattgagagtttcctgattatcctgaattaagagcaagttacttcgttcatcaaaactaaaagttccatttgatgaaagccatgaaccttgacctgtagtcagtgatttcattacatcagccgctttagcataatgtaatttgatcgaagtcgtcgttaaatttggctcattagtcgattttgacaaattttcctttgtatctaattgtatatttgtctctttttttatgcttctttgtcttttatcaaagggatctctagcagataattccacacttactgtgaataagaacaaaaagaaatataagaaatttttaattaacataggtattctccatgactaaagttgtaaagaaatatcggcttgaatggaaaaatcttcattttcactatgagaaatttgcaacgaaactaaattgagtggaacttgaggtaaaagtgcggttaaaaattgagataaatcggaaaaatagcctttaacgtgaaaagttaaaataggttgatttcccatttgccaatgagattgttcaaataataattttccattatttaacaattgtaatttttgattaatttgtgcaagaggtttattaaactcaatattattttgttgatagcgttcctttaagctggttaatatttgttgcctgtgaacaagtcgagcatttttttcgtcaatttcaacttgaagtttgtgtgcaatttcttgttgctgaatataattgagcgagggataaattgagcttatcaaaattattaagaaaaaaattaaaatttgttttagtgaagataaatttacccattttactaacaaattatcagaatgctgtaacttcatgatctattccttatgttgagttaaacttaattcaaattcaaatatgactgatcttctctgatcaatttgtttttctttaaaggtcaacagttttacatttgaaaacaaattttgttgtttcaagaatttttgtagctgttcaacttcattatttttctccgtttcaccttgcaaaattaatttttcaaaatctaaggacagctcgtttaattccccactttgtaacggaagtttagaaattgttgttaatattgataaaaattgttcattcggtaatttttttaagttttttgatttaccgccataatttctttgtaatgtagaaatgttctgttttatttttgcaagtttattgtcaatttgttgtatttgctctctttttttatctatttcggtgtcaattttttgagttaaataaagtataaaagttacaccagcaagacagataatgaggctggcaagtgatttataaataaacgattttattttttgtcgataaatttcttgtcgccaaggtaataaattaatttcaatattacgcatttattattcctttaattccgttatttgatagagttcatgtcttccccaaagagcatttcctaaagcaataaaaggcaattcggtattaatgatgttccatttatgagtgatattttgttgttcatttttttcacaatagcaccaaacgtgttgaggttggcagttaaaacgttggcagaattcttgataaagtgcggtaatatttttgtcatttttttgtagaacgattgtttgttgtccgatttcttgtattgctatacagccgttacgatcctgatataaatataatgtttccatcttttctttttgggggtgaaaataatggaatgctcgtagtaggctattacttaagcaatctaatgtattaatttttatagggaaaaaacgatgcacataattttgagctgtttgttttctaacaacgtagatagccagttttgcaccttgtgttaattctttatattggtagtcgtaccaaatatcatcgaaatctgtcggcaattcattttctatgattaagttacattgttgttggcattcttgctcatttaacttttgcgtcaatatgattgtttttacccagacgtgctgattgggtaaacaggctatccatgtgcagatattctttgcgaattgtggtgtcaaatcagatagtttaagagggggattatcgtttttagttaaaaagtgcggttgtttttgttcatcaaaccagaggaattgccattgttcatcttgtctatgaataccaatttgtaaaatatttgctgtttttttgttaggtctcatttcatattctctttaataaaatttatattttaaaacttagctttattagctaaatcctttatacttacctcattgattatcgatatatttttttcaaatacattaaataagagagaattttacgatgaggatcgcaaaattaatatttagtaccttactaacgttgattattttagggtgtgttgtagtcggtattttttacattcagataaagaaagatttgcccagtgttgatggtttaaaaacagttgagttacagcaacccatgcaaatttatactgctgatggaaaattgattggtgaagtaggggagcagcggcgtattccggttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacctaaataaaatttatttcggttaccgtgcttatggcgttgcggcagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgtggcgataagcgaacctattgttgcctcttatcatggaacacagttagaatttcgagctgattatgtgagtgaaatggtccgtcaagaaatggtaagacgctttggcgaagaacaggcttatacgaaaggatataaggtattcacaacaattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattccaatccatttattcctgctgctgttctgtccataagtaaaatgggcgctaacttgttgttagcggatggtaagaatattactttatctaacaatgcgatgcgttgggcgggtaaaaaaatgcctaaagagggcgatcaaatttgggtaagacaacagaataaagaatgggttttagggcaaattccggaagctaattctgcattagtttctcttaatagtgataatggtgctattgaagcgttagttggcggttttagttttgagcaaagtaaatttaatcgtgctacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggagaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgctaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttaataaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagaacacttcaagcgtcgtgatattggcggaaaaacgggtacaaccaataattctaaggttgcatggtatgcgggatttggtgcaaatctagccactgtggtatatgtcggatttgatgataataaaaggagtttagggagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatattttattagaggtacggaacctaaaagaacattcgttcaacaaggacgtggttactaccttccttctgaaacggatctgccaagtgcggaaccggaagaaattttctaaaacaaaccgcactttgtaaaagtgcggtctatctttcattattttataaggctaagtttatgctaagttatcgtcacagttttcacgcaggtaatcatgctgacgtgttgaaacatattgttttaatgttgattattgaaaatttaaaattaaaagaaaaaggattttattatttagatacacactctggtgtcgggcgttatcgtttattcggtgatgaagcggaaaaaacagcggaatatcgagaggggattgctcgactttgggcaaaagaggatttacccgaggcaattcaacgttatatttctttaattaaaaagctgaattacggtggtaaagaattacgttattatgcaggttcgcccctgattgccgcacaacttttacgctcacaagatcgtgcattgttaacggagttacatccggcagattatcctttgttacgcaatgaatttaaggaaatcaataacattagtacaaagcgggataatggttttcagcagttgaaagcgactttaccgcctaaagaacgtcgaggtttgatcttaattgatccaccttatgaactaaaagaagattatgatcttgtggtaaaagcaattgaagagggatataaacgttttgcaactggtatttacgccctttggtatcctgttgtattacgacaacaaactaaacgaatcatcaagggcttggaaaatagcgacattcgtaaaattttgcagattgaattagcggtacgtccggactccgaacaacgaggaatgactgcaagtggcatgattgtgattaatccgccatggacattagaagatcaaatgaaaaaaatcttgccttatttgacccgcactttagtaccagaaggaaccggtaattggtctgtaaaatggattacgccggaatagaaaataccaatcaaattaatttattcaggcagttggtttttttggcaaatttttagcagaatacataaacttaaatataggagagaaaaatgactaaacattatgattatattgctattggtggtggtagtggcggtattgcttcaattaaccgtgctgcaagttatggtaaaaaatgtgcaattattgaagcaaaatatttgggcggtacttgtgtgaatgtcgggtgtgtgccgaaaaaagtcatgttttatggtgcacaagttgctgaagctattgcaaaatatgcacctgattatggttttgatgttacgttaaatcattttgattttgccaaattggttgaaagtcgtcaggcttatatcgatcgtattcatacttcgtacaacaatgtgcttgcaaagaataatgttgatgtattaaatggatttgctaaattttttgatgcaaaaaccattgaagtgagttatgcaaacggcgaaaaagagctggttacagcggatcatattttaattgctaccggaggacgtccgagtcgtccgacaattccaggagcagaatatggtattgattctgatggtttttttgcgttgaccgaattaccaaaacgcattgcggtagttggtgcgggttacattgccgttgaattggcgggcgttgttaatagtttaggtgcggaaactcatttatttgttcgtcggcaaacgccaattcgtagctttgatccgctgattattgaaactcttgtcgaagtaatgaaacaagatggtattcaattacatacgcaagctattccacaagaaattatcaaaaatgcggataattctctaacaattaaattagaagatgggagaacgcaggacgtagattgtttaatttgggcaatcggtcgggaacctgccactgatgtgattaatttggcttcaacaggtgtagaaactaacgaacgtggatttatcaaggtagataaatatcaaaatacgaatgttgaaggtatttatgccgtcggtgatattattgagggaggaattgaattaacgccggttgcggttgcggcaggtcgtcgcttatctgagcgtttatttaataataaaccggatgagcatttagattaccatcttgttccgacggtagtatttagtcatccaacgataggaactgttggtttgactgagcctaaagctattgaacaatacggtgcggaagcagtgaaagtttatacatcttcttttacaccaatgtatagtgcggtgacttcacaccgtcagccttgccgtatgaagctggtttgtgttggtaaagaagaaaaaattgtcggtttacacgctataggttttggtgtcgatgagatgattcaaggttttgccgtagcgattaaaatgggggcaactaaagcggactttgataatactgtcgctattcacccgacaggctcggaagaatttgtcactatgcgttgataaaagtgcggtattaattaatgaaaaaaggattgttctctaccttagaggtcaatccttttaatagcgtatcttgatttagaaagatattctcgacctttcaaatgattagacataaaaaaaataactgttatactgatcaacgagtggagaattcggtttatcttcaatctatctcctataattagtataagaaggaaaagaaaatggcaaaaggacaatcactacaagatccttatttaaacgcattacgtcgtgaacgtattcctgtatcaatctacttagttaatggcatcaaacttcagggtcaaatcgaatctttcgaccaatttgttattttattgaaaaatacagttaaccaaatggtgtataaacacgcaatttcaacagtcgttccggctcgttcagtttctcatcataatagtgttcagcatcaccatattgttcaaactcaagaaatgcaagcggaagtattagctgaaaatcaaactgaataattttgaatacaaacaagcaattcaaagtatataccgcaagtgcggttgattttgcccaagatcctaccgcactttcttccaacataaatgtgcctcaatttgacaaagcaattgtggttcatgttttcttttctcaaaataaaaatctagaggatttacaggaattccaacttttggttaaatcagcaaatgttgatattctttcaataatcacaacctcacgctccacgccacaagctaaatattttgttggacaagggaaggcagaggaaattgctcaagctgttgaacaactcaatgcggatattgtgttagttaatcatagcttaacacctgcacagactcgtaatttagaaagtatctgtcaatgtcgtgttgtcgatagaacaggattgattttagatatttttgctcaaagagcgaggtcgcatgaaggaaaattacaagttgaattagcacaactcagacaccttgcaactcgtttagtccgccgaaaaacaggattagatcaacaaaaaggtgcggttggattgcgtgggccgggtgaaacacaattggaaacagatcgccgtttaatcaaagttcgcattactcaattacaaaatcgcttagaaaaagtagcaaaacaaagaaatcaaaatcgtcaaactcgccgaaaagctgatattccgacaatttcccttgtcggttatacgaatgcaggaaaatccactctatttaatgtgctaactcaagctaatgtttatgtggcagatcaattatttgcaactctagatcccactttaaaacgtttaccaattcaagatgtagggaactgtgttcttgctgatactgttggatttattcgtgagttgcctcatgacttggtttctgcgtttaaatcaacattacaagaaactactgaagcaagtttattgcttcatgttattgatgtcgcagatagccgtaaattagaaaatatgttgacggttaatgaagttttaagtgagattaaagcaaaccaagttacaacacttttagtgtataacaaaattgatcaagtcgagaatattcaacctcatattgaatttgatgaagaaaatcaaccgattgctgtttatctttctgcacaattaaatcaaggtttggatttattagttgaggctattcgacaaaaattaagccacgaaattctacatttagagatcaatcttgctgcacaatacggtaaaattcggcattgtttttatcagcttaattgtgttcggcaagagaaaatcaatgaacaaggtgaattcttacttgatattcaaattgataaaattgaatggctcaaattaagtaagcaatttccgctattgaaacgtttttatgaaacaacagaaatcagcgacaaataaaccgcactttttaagtctatttgacaattccgtattgttttaatttattggcaatggctgtatgcgacatccctaaacgggctgccaacttacggctacttggatattgctcataaaatttttgtaacaccattgactcgaacttattcattatttgttctaaggtttcaccggcaaattgatcaacattaaccggcaaaatttcttgctctgataagtttaaatcagcaattaccaactcattatttttggctaatgagcaagctcgatataaggcattatataattcacgcacatttccagcccaagtataatttttcagatattgaataaaccgctcattaaagtgcggtactgaaatagaaagtttttcactaatttgacgaataaatatttctgtgagaggctcaatatcttctactctttcacgcaacggtggaatagtcaaacttaaaacatttagacgatgaaacaaatcttcacgcattttaccttgttcaacatagtgttgtagcggaatttgcgatgtgcaaattactcttacatttgcacaatgttctttttcctcgccaacacgacgaaaagtaccatcgtttaaaaaacgcaacagttttgcttgtagctctaaagaaagttcagcaataccatctaataataccgtccctctattggcatattcaaaaaagcctgttgtttcaattcccttatccaaacgaccgaacatttcactttctgcatcttcagcaggtagccccgcacaatttatggcaataaacaagtgagccttacgaggaccggcattatgactggcttttgcaattaagtctttccctgttccggtttctccttgaatgagtaaaggtgcgtccaatccggcaaaagcttttgctgtttcaattaacgtctgcatttttacacttttacatacaatatcatcaaaagaaatcagctttgtcataatttaccccattttaaatcaattgattttgtattctaaacgttgaacaaaaaatgtaaagaaaaatgaacaccaaagatgaatatgtttactcttgatctacatcacaaaaccgaacatttacaggttcagtcagttccaacactactactaaagtgttaaaatctcctcaaatttttaaattcactttaatagcgaggtataaaatggcatttcgtatcgaaaaagacactatgggcgaagttcaagttcctgctgataaatattgggctgcacaaacagaacgttctcgtaacaatttcaaaatcggtcctgaagcttcgatgccaaaagaaattattgaggctttcggttatttaaaaaaagccgccgcttatgcaaaccatgatttaggtgtgttaaatacggaaaaacgtgatttaatcgctcgggcttgcgatgaaattcttgccaataaacttgatgaccaattccctcttgtaatttggcaaactggttcaggcactcaatcgaatatgaatgtcaatgaagttgttgcaaaccgtgcacatgtcattcaaggcggtaaattaggagaaaaatccgttattcacccgaatgatgatgtcaataaatcccaatcttcaaatgatacttatcctaccgccatgcatattgctgcttataaaaaagtggttgaacatacgttaccttgtgtcagacgtttgcaaaaaacgttagcagaaaaagcagaattatttaaagatgttgtaaaaattggtcgtactcatttaatggacgctacaccattaactttaggccaagagttttcggcgtatgcggcacaacttgctttcggtatcaaggcactggaaaacaccttaccgcatttgcgtgagcttgccttaggtggcacagctgttggtacagggctgaatacacctaaaggctatgatgtaaaagtagcggaatatattgctaaatttacagggttgccttttgttaccgcacaaaataaatttgaagctcttgcaactcatgatgcgattgttgaaactcatggtgccttaaaacagttagcagtttctctttacaaaatcgccaatgatgttcgtttattggcttcaggtccacgctcaggcattggggaaattctcattcctgaaaatgagccgggttcatcaattatgccgggtaaagtaaacccaacgcaatgtgaagcaatgacaatggtttgtgcacaagtactaggtaatgatgtcactatttctttcgcaggtacacaaggtcatttccaattaaatgtgtataaacccgtcatggcatacaatttcttacaatcggcacaattattaggtgatgcttgtgtgtcatttgatgaacattgtgcaatgggtattgagccaaactatccacgtattaagcaacaactggagcaatctttaatgttagttaccgcacttaatacgcatattggttatgaaaatgcagctaaaattgcgaaaactgcacataaaaatggtacaacattgaaagcagaagccatcaatcttgggttggtgagtgcggaacaattcgatgaatgggtacgtccggaagatatggttggcagcttaaaatagttcacttattgaacatttaattaaggcgagatgagttctcgccttattttttactacaatagctttaacttaacattattttttataactgaattggttccaattttgatttttgttccgtagttaaaacatctgttgaaataatatgtaatccggttttgttattcagtcccaaatcagcatggaaataatcaggtaatttgtacattgcacctgttataggatcaacaataagtaacccaattaagcctccaaatacaaagtttccaatataccaaccatcaagttttgcttctaacagaaaagtttggcttttggcatttttaccttcaggggtaaaagtaatttcatatttttcgcctttgaaatatccggctcctgctggtaagacaacattttgaggtgtttttcctgatgtaataacttttccagctctattttttatcacaaagtaggcattactagggtttgattgaattgaaacattataattgcgtttactcacgatagttgcacaaccggtagcaaacatagcgacaactgctaatactgataattttcttaatcttttcatggataaatcctcttaaatgtgtaaaatggtaacaattatactaatctgtctattagtgttcgaagttagattttaggtaacaatctatattttgactagaaacgaataagataaattactacctaaattgtgattaaaattacccaatttgtgaggttctcatggcaatgcataataaaattcgcctgatgcgggaagtccgccaatggtctcaagaagaaatggctcataaaatgaatatgtctctaagtggttatgcaaaaattgaacggggcgaaacaaagttgcactatgataaattggttcagattgctcgtatttttaatatgaacttagcggatctgatagatattgataaaggtgtaattttttgtatgaatgagaacagtgattatatttatacaaattatggcaatatgagtgaatcatcgttaattgaaatcgaaaaattaaaactgacgcttgcacataaaaatgagttgcttattcaaaaagaaaaagaaattcaatcacttaaaaagattattaccctgttggaaacttcaaaataaggcatttctctgatgtatcgttgattggcaagaacaccactttaaaaattacctgttggcgaaatgatatatgttttaattactttgctggatcataatattccgttatgtgttcttttagtgagccggttgtccgaaaaaattcattggctgatgaaatagcttaaattttccagcatttcattaattatttaacctcttatctgtttgtctttccctttaaaagcgtcttattttatcaatcgtctttgtgaaatttttgagaaaaatttgaaatgatatcaaatgcttctgtaatcattcgcctgttgtaataattgccgactttctttcaaaaattgctctgaatactcaccaaaccattcccgcacttgattaaaacagtcaataaacccctgcttgttattatgttcaaagaaatttagactttcttcatagctttgttttagactcttaatcacttccaaattctccgatttgtccataataatatctgcataaagttccgcatcttgagcaaataaacgtccgatcatggctaattcaagacgataaatgggtgaagatagggcaagcaattgtgccaactcaataggttgttttgataaatgcaaaccatttgcaaaggttgaaaaatgacgtaaggcttgtacatacgtcatacttttatcatgttcggttgcatcaacttgataaattttcgctccccacatttgaatttgttccaaaaaccattggtatttttcagggtagcgaccgtcacaacgtactaccacttgctttgccatattggtaatatccggaccaaacattggatgtaatcctaataccgcaccttgatgcacttgtaacattttttccaacggttgacgtttgactgaggttaaatctgttaatagcatattttcggttagataaggctttagacggtcaatcacatttaaagtttgtgcaattgggacacaaacaataactacatttgcattttgtaaaattttatccgcactttgccaatcctgtttctctaagacagcaatttgataaccggaagaagacaaataacgagcaaataatgcccctaattttccctttcctccaacaatgacgattttttttatttcaggatttgctgttttaaaaccgtattgattttctctagtataagattcccgcatcaaacgacgcaaaacatcttcaattaaatccggtgaaacacctaacttttccgcttcattgcgacgagcctgtaacatttcattttcacgttcaggtacataaatcggtaatccatattgatgtttcactttgcctacttttctgactaattctaagcgttgagaaaaaaggtgtagtaattcacgatctaagcaatcaatttctgttcttaaattttttaaaacgtccatagctattttcatcttactaatatagtttgtacatttattattacaatggttgtaaaaaataacttacaaaataaatatcaaatacgcaactaaattttataaaaaaataccgcactttgcgttctgattaatccgcaatcgtttgcttgtgtaatttatattatgctattcttagcattatttttagtaaaggaattcttatgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgctggtggtgccgcacatttacccggtatgattgcagcaaaaactatcgtgcctgtattaggtgtgccagtaaaaagctcaacgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataaggctttaattcttcattaggtaatgttgagcaatgaataaaaagccgatagttaaaacatcctatcggctttatgacttggtcagaaaaattaggctttataatttttattcaaagcaaatgtatatcctctcaaactgttgtttaggactttccggtatccatcctgctattcttagcataagtcatttggtttcccaagccattttaattagttgtcttttgacactactaagagttcaatacctttttctctaattttttctctcatttctaaagacaaaccttcatccgtaataattgtatggattttatttaaaccacacacaatattcgggctttttcttccaaatttgctggaatcggctaaaaccacaatttttttcgctgcatcacacattagagaactcactttatagacctcattaaaagtagttagcccaacgtctaaatcaaagccatcagtaccgataaaaagtatatcaaaggttgaaccgataaaagcagattcagcaaaataaccgtgaaaagaagccgatttttcacgaaatgtcccgccggaaattaataaattataaggtttattcagtactaaaatagcattaaagattgttaaactatttgtcattaaagaaagattatcaaactgctttaagtatgggatcatttgtagcacagtactccctgcatcaaaaatgaccgaatttccttcactaataagcgttgctgctttttgcccaatacgttgcttttgttgaatattaattgctgttttttgtgcaatcggtttatcttctttgtcctctttattgattttttcttctcgttcaagaagttcttcatcaattaagacgacacttccataagtacgtaagacctttctatcttcttcaagtgcggttaaatccttacgaattgttgcacccgtcaatttaaaatgagtagccaaaacatctacttccgttcgcccatattttgctaaaaacgctaaaattagctgtcttctttcaaaaggtttcattgttcctccaatttagcaaaaattggagcgaaccaatctatgctaatatagttttagttttgtcatgacatctaaaagtgaagccattctttcatcggcaattgaaaatttttcattttcataattggaattcaccaaaaatgtagttaaattggctgctttggctgcaattaaaccagtaatactatcttcaataacaatacattcttgtttttcaatccctaatttttttactgctctcaaatagacggcaggatgtggtttgccatattcttcatccattgcactacattgaattgggaagtaatcccacaattttaagcgatcaaaaatggtcttaattacaactggaggcgatgatgtagcaactgccagtttaatatgattagattttaaaaacgctaataattcatacagccctttcaaggctatacctgtttgtgcaattgcattacagccattttccaaaattgcttcacttaatttttggttggatacggataagttaaattttttaatccaagtttcactcaattcatcgatccgtttacccctagtgaatttttcacactctttctcggtaattgcgataccaaattcagccaataccgcaatttgagcctttgcccattgaggttctgaatcaatcattaccccatccatatcaaagataacactattgatttgcatcctttttctccattatcgcatttttcaatgaaaaaatattcaaaatgaaataaaatttacattgttttttgatcttaacaactatatccggaagatattgctacttttaacgcaaattgtgagcgtttatcagttggaaaaattttttccggaataatttgatcaagaggtaagccaatgacgtcaactaacttttgtggtctagcaaaaacagaaaaacctttcatgtgaagactatccacaacttttttctcttcattaaatgccaagacaatcacagattttggattaaaacgaccgctgttacgcccaacagtgatttttcctttcttgcttatttctagaaaagcttggttaaaggctctaatttgtagccagcctagaatagattgcaaaagccacattataattgagaatgtaatcagcaatgtaattggatccatttttacctcttaataaaaagccatagagtctgaataatctggctgtttactcatttagaacatcacttgaccgccagtaatattaattgactgtccagtgcaataagccgcttcttcgctagcatagaattttaaaacattcagtacatcttgataatcacaacctcgctttaaaggtactttatcaatataaacttgctccacttcactctccgagataccaagtttagccgcatattgtggaattaaagattggaacatcggcgatttcaataaattgcctaacattaatgaatgaactgtaatgcctttgtcagcaagatctaatgctaaggattgcgttaagccaacaccgccaaattttgccgcactataaccagaattgtacttacttccgactttacccgatttagagttaatttgaatgatacgccctttaatgccatcacgaatcattaaacgggaaaaatgcttggcagttaaaaagtaacccgttagattcacttttactgataaatcaaaatcatttaaattgaaatcccaaatgggtgaagcttttgcagtacctgcgttatagaccaagacatcagcacgaccaaatacacaatccgttacttttgtcaaagcttcaacgcttgattcatcgcccgcatcaacttgcaccccaattgcatttccttcgccttgcttgacgttaatatcagcagctactttttgtgcattttcgccatttaagtcggcaacaacaatacgatagccggcatccgctaaacctttagataaaaatgcccctagtgtttgaccaccaccgacaacgatggctacttttttttcattattcataatatattcctttaactttcaatttgaaatcatttctaatttggacttaatcacgtttaataactaagatggaactttccattaatgtttttggtggaacaccaacaacatgaacacttcccggaaattccgcttcggtcgccccatcaaaacggaaagtaatgtgtccgagtgcggataaattatccgacgctacactgccaatggcggtaatcggatattcaacaccatcaaattcggcaatatcgccaacttgtaaagcgtcgcttaattcagatggattgtgtaagaaacagtaatcttctaaatcggcaggtgcattttgtttgaaagtgattaacatattgtcgtttagtgcatcatgagcaaaattgccgattttagtaaacgttgttttatagataatcgtcatttgaatattccttttgttttacaagcggttggtttgcaaatttaaccgcttgtaaagtgattactgataaatgaatgcagataccgcccatgcaattaatactgtcggtgcaccagtcaaaaaacgactgactaatacagaaggtacgcccactcgcacagtatcttgtttcgcttctgccattgaaagccccacgggaatgaaatcacaagcggcttgagcattaatggcaaaaagtgccggcagggctaaatgtggtggaatgttccctaaaccgatttgtgtccctactaatacaccgataacttgagcaataacagctccgggacctaagaatggagagagtagtgggaaagaacaaattaacgcaagagtaactaaaccgagtgggctatttgcaagcggtgttaaaccatgagcaattaaatcccccaaaccggaagcaataatgattccaatcaaggcggaaacgaatgccataaacggtaaaatggttttcaggactgtatcaatagtatcacgtccggcttggaaaaagagtgcggcgacagaacccattcccatacctatttttgccaataaaccattactttgttcggtgatttttttacttgaatcatactcttttgcggtagttgatgaagcaattttttcttcagatatgacagaaagggctgcggcatccacatcaattaacgaaatattattttcttttacggcagaaacataaatatcttcaacaataaattctgctaaaggtcctgatttgccggttgcgtgaatattaatagttggaatgcgacgttttgggtaaagcccacaacgtaatacaccaccacagtcaacaattgcaattccaatttcttctgctggcggttcgccttctttaaaaccatctactgcttcccagccagttaattccaccaatttattcacaatagcaggacgagtgcctccggtcatataaagtatttttttgccttcaataatagataatgttaatggaccaccccaaccaccgttacctttttcaatataaactgctttattactcataatgtattcctctacttttcattccgtttaattagtttagtgagatagattcacttctctatctaatgtaattcccattcttttttcaaagaaagctgtggtaaagtccgtaatccaaccacggaagaagttagtgaacatgccgactaataaatagctaacagctaaaggcccaagaggtaatcctaaagtcgttaaaccactggcaatacctaaataaacgaataattcacctgggttgatatgaggaaataagccgttcattgagtggcagctataagatgctgcggcgtagtaacttggtttataacgctctggtaagaagcgtcctaaacttaacgtcataggattgcaaaaaacgaaagtgccaattaccggtaagatcaagtaacgtgaaataggattgcctgcacttttctgtgccagtctttctatacgatcttgcccaataaatttaattaaggcattcattacaactagtaatgagattaatagaggtaaaataccattcatcattccgactaaggtttctccccctttttggaacaaaccgataaaccattctgctccgtgtgtgattgcttcgatcatacgacctccaattttcaaaataaaacatattttttcatctctgcattttagagacatgtaaatagtaagttattttcattttaaaaactgtgaagttgatcaaaaaatcaaaatttatttcaaaataaattattattgtttcggtttgaaatattgattgagtaatttggacggaaagaggcaccttttgttttaaacacataagaatttaagttaagtaaatgcgaaaaattaagcctttttcatcaagcaattgatgatttattcgtcgcagagacgaataaaagtacactggttttaagtaatggtttggaaatggaaaagggcgataaacccaaaccacctcattatcatcatgtcgtgcatgataaaatgatgcaccaagcagtcaaacaacatttttagttagaaaaacaatgactcacacacgatggagggcggattaaatcagcaactcttttttattgatgatattcaaggttatcgtgctgagaaaaaatcagttttcaggcaatctgaaaatactttttgaataaatggtcatagttgaattggaaaatatcctaaaaattaaagtgatgaatttttcaggatatttttattttaaacttgacatttaaaaaatgtcatgacaataaaacgtaaaaagtttattatggtaagaagggaatgaagaaaaaatatataactgcaattctgttattaatatcagcatatgcttattcatataggattaatgttatagatgattatgatttaattgataaggaatatatagaattttggaatagagatgaacttataaaacagatagaagtattaacaatagaattattaaacagaggttatgtaacatcgaaaattattgataaagaagagaatttagttattattcctggaaaaatacaaaaagtaatattacaagataattcgacaaaaaatgcaaaattaaaaaaggaattattaaatttaaataaattagagggagagatattaaatattcgtgatattgatgaaatagtatctaaatttaaaaaaataaaaggtaataatgtaaaaataagggtggaaaatatcaaaggtagtcaagatagtaatataataatcataaatgactttaaacctgcgatatatcctaaaatttctgcagattattctaaaggtattaattcggattcttatcgtggttttaaatatgttgttggatttggtttcgaacaattaataggtatgaatgacgaattaaatgtgaacttttctctattatcagattatagaaatatgagcttgaaatataaaatacctataagaaataatgaagcaacaatacagtatcagtatacgaaagacattttaaatgaagatgtagaaacaatagaaagagaaatattattgaatgtaaatacggatattaataatatagatttaaataattcgataactataaataataaaaggtttaatgtaaggaaaaatacgaatataacaaacaattggttttatgagtttgaaacaagtttagtgtatacaaaattattgaatttaagtggttattatgttcaattaatgttaaaacctaaaataggtataaatattgcggatataagagcatataaaaaaaaggattatgtaattacatcaggtatagattttaatttatattctaaatactatgatttaataacgaatgtgatttataataagaatatgagttcggatagtgtgtatgatcgttatacgagaaaacttaatatatatgggattgataatatcccgttatcaatagcaaagacagataaactcatagttatgaataataaaatgaaatatccaatgacaataaacaaaattaatgtaataccatatatcgatgtggcactaggtagtaattttaaagaatattcaactggaatgagcataggttcaaaatttaaatataaacaaacaagtattaatctagaatactcaaggagtaataaaggtaattcagttttaaatttaaatttagggtttgaattttagtgaaaggaaatcttagtgaaaaggagtagttatgtataatgagaaaaaagtattaacaatggtatatttatttgcagtgatatccgctcaagtaaatgcacagaccgtgaaaaatggggacacggaggtagaaaagaaggatggtttcgatataatcaatattaacacgccaaacacaaagggagtttctgttaataacttaaatgaatttaatgttaaagataaagggacagttatcaataacattgagtctactcataaatataagacagttcattttggtgaaatcgatggaaataaaaatataaagactaaagaagcagatatagcagtgttgaatgtgaaggggacgagtaatacaagcttaaattcaactttagaagctgcatcatcaaatccactaaaagtatacatagctaatgaaaatggtataaatgttgatggtggtaaatttgtaaatatcgacaaattggtactgactacaggtgttgttgatgacaatgatatgtcagtgtcggttaaaaaaggtgatgttaatgtttcatcaaaaggaattagcggcgttaaggatatatcgatatatagtgaaaaattagataataaaggtaaaattgctgcagaaaacacaaaaatagtactaggacatagttctataaaaaataatgaaatatcttcattagatgataattatgtgagtgcgagtgatttgggggctatttatgggaatgatatacaaattcagtcgacgggatatacggatattaatgttaacgaattattagcaaaaaataatattaatattaattcaaaaggtaaaattaaaaacaatggagatattatatctggaaataaaatagatataactgctaaatcgcttgaaaataaggggactgtagattttggtaataatacacatgaattaaaatggatagatgctaaaggtaatgtctacactaaagaacaattagaaaaagtgtggaataaaagaatgaaacaaactttaacaccagaatatgcatttctttatttgacgggttctttattaaatcaatgggctactgatgaagaaatggcaaaaaggttaagcccagaggctaatatttttaaaagatttgatgaaactttaaataaatttaatgataaagatataaatacttttttaattagaaaagataaagaaaaagttaaaaataaacataaacaaagagattttgttaataaaggagatatttatgcaactgagatagatgataaaaaaatattagaagcagttgcagtaagtaatgttaaagccaatcaatctattatttcttcaaaaaacattaaaattaatttgactgatgatttattaaatcaagatgctagtatagaagctattgatgaattagatattaaagctaaagctaaaaaattagttaataaaaatagtttatcaaatgatataacattgaatgatggatatgaaaatttatcttgggatttaatggttttacaaaaagatataagagccaattatgatataatttatgaaaaaggcttggtttctgatcaggcagcaagaaaggctaaaatagctgctgtgaataaatcacaaattaaggctaaaaatatgaaattagatgtagataatatagaacttcacgatgatataaatacaggagcatctattaaagcagataaattagaaacaaattctaaaaaaataagtttaaaaggtcaaagtatagaagctaaagaatataatatgaaaactgatgagcttgttttgaataattcaactatttatacagataatatagatattggtgctaaaaatgttaaacttttaagtaaaaaagataaggaaatagtaataaaaacaggtaaagaaaatttaacaaaagaaattatttctagttcaggtatttatgctaagaataatttaaaaattaaatcaaaagaattgcaatcaaaaggttcaattattaaatctgataataaagtagaaattaatgttgatttactagaaaatcttgctgaaaaagttacaaaagattataaatcatcttatgatatttctaaaacatttagaaaaattaaacataacgaaaaaagtgaaagagcggtagctagttttatttatgcaaaagatttagttttaaattctaaaaaaacaaataatgtagggagttatattgtaggtaccgattcaataaactataaatcgggtacaactaagatagatgccttaaagattaataatgaattagacaaaaattatggtgtagataatggtatattaggtataaactataataaagttaagaagatggaagatgaagcagttgggtctatagttttaagtaaaggtgaaataaaagctaagattgataaagagctagaaataattggaagtagccttaaaggtaaaaaaatctttatagaagctagtgatgttaaaataacttctaaagaacttgacaaaacaacagaaactgaatcaagacaattacttgctggggatttaaaaggtggttttgaaaagaatgctactttagataatatatcagcaaaagtagatatggaattatataaaaatgaaaaaatgatagttaaagaaaaaaaacattcaaaatcagaaattgaaggagaaaaagttacaatagtagctaaaaatgaaaattcaataaaaggttctcaaattaatgctaataatttagaacttaaaggaaaaatagttagaatagaagatgatatttctaaaactgaggttgagaagaatacagtaacggtttcagcgactaataaaattgcagtaaatgaaggaaatttagaaagtgataataaattaataattagtaaaactaaagaaaatttaaatactgaaacttctaattcctcaaatattaatgctaaagctaatgtgaaaatagaagcagacaaagtgttagtgaaaggttctaaaattgaaggacaagaagtagaaataaaatctaaagaaaaagttgatatagttaaatctcaaaccaaagaagattataaaaaggattctgaaacagttacattagggtctaatgttaaattagatgctaaatctgttgcaattattcaaaccttaaagaaaatgtatgatgaaaaagacaatctttcaggatatgctttaaatccagtgtcaggatatcaaaagataaaagaatataaggtaatgctggaaaaaaatattgataacattaaagaattagttgctaatgtttcagataaaaaactagatcctgaatctttaggggtaacgatgaatgttgaaaatagtattaaatacaatactaatcatttaacatcttcaaaatttgataataatgaaagtgaaattaaagctgataaagttacaattaaaacagaagagttatcattagaagcatctaagattaaaggaaatgaagttaaaatagaagctgaaaaagtgagtttagaatctgctgagaaaaaagtaaattcaaacgaaacagatgccagtgttcaagtagctatggtacatgaaattataagtcaaaatacattatttaaaggtgattcaactgttcaaaacaaaggaaattataaaacagaacatacttcaagtaaaatagaagcagaaaaaatagatttaaaagctaaagaattaaaattacaaaattctcaaatagaaacaaaagagggtaaagttgaaactgataaattaagtgtatatgataaggcagataaagaaactaaatatggcgttactctagcaggtatgtataatggaggtacaaaaattggggttgggagtgctacagctaaagtagagcatgatcaaaaagttaaaaatgtatctattgtaaaagttgaaaatggtaaagttgatgttaaaaaagaagataaaaagaaagatatagaagtcaatattgatgttaatactcaattgggattaaatgtagatccaagcggtgatgttaagggtaaagcaagtggtggagcaaaaactaagctagattcaaaaggtaaaaaaattcaaggtacaggttatgtaggtgttattggagatttagcttttgaagatggaaaaatcacagatgtaaatgtgagtactgagcttaaaggagatttgacaattacaccagaaaaatatgttgatgaaataaaattaaaagttaataatcgtttatctatagatcatgatggtcaaataagtaatgatttaactggtaatttatctactgttactcaaattaatactgaaaatatcaaaagcaaattaaatgtaggtgtagacggtaatctagttactaaaaatatggatataattcaaggtggaataaaaggaaatgctgctggagaaatagaagcaatagtaaaaataaatgataccgtcgaatctaaattaagattgatggctgaaggtaatgtaattaaggaacatggaaaatacataaaactagattctgaattatcgtcaaatgctaatttgaatgtaaaaggtgcaactaaaaatgtttccggctacattaatttagctaataattcgagcataaaaattaataacgaaaatggcattaaagattattcaatagataataatgttgatggtaatctaaagtctaaaggaagtataggcgaaaatgtttcaggagacatagacataaatttaaaatcggatttatcgaaaaaaatgtctcaaaatataacaactagtaccgctgttatggggaacggaaatctaaaagttgaaggaaaactagaaaatttagatggaaatatgggattaaatctaaatggaaacgtggcaggaaatgaggcaggattacaagagttaacaggaaatgctaaagctgatggaaaattacatgctcatggagtattggaagcgtttagtggggatgtaacattagctggaaatactgaattaaatgcaaaagtaaatgaagcattgaaattaaagggaaatttaagtggtcattctaatattagtgttgagggacagacagatgtagtaggtggcaaaattcaattaaaacctcaagttaatatatcgggagataatgttaataaattaacaacatttgatacgagtactaatttgaatggatacattgaatcgaaagtgaaaaatgagtatgtaagaaacattaaagcgaacctaaatactatattcaaaactaaaaagtttgaggtggagacttttgaatcaagtcttgatagtgaagttagatctaaatataaggatatagaatttaatttagcttcaggagaaagaatatcattaaaagactatattcaacaaaaaatatctagtgataaataaaagtttaaagaaaagaaaatttttaaaacaaattttgatctgacactaaaaagttggactgctattcaaaggactgattttgatattgtatcggactcagtccttttaattgaatccgttcttcgttgtaatttaatcagttggttatttagtcctcctttcggaggcttgatcaaagagtagttttctgttttataaaattttgggtagtgaataatactcaacgccatatcaacctaatatcaaaacaacatactgaataaacaaattaaaaggatattcctagtgcttgtttcattatttgttctttgacgaaaccaaatcggttagtggtatttaaacctataccacgtactaactttttcactggattatcgccgttaaagagttcttttagtccctgcattgtcactaacattttgactgccgctgttttctggcagcgttcataatgacgcaaatatcggtattcaccaatatccattcttaaagctaaatttttgttaatttcttgtgcaagtataacagcatcttgaaaacctaagttgactccaagtccggctaaggggtgaatagtatgagccgcatctcctactaacacaatgcgatgtttggcaaaactacgtgcataacgtgcagttaatggtataactttgcgttctccacgcaccttgcataatcctaaacgattgtcaaaagctacagataagtttttattaaattcattttcctctgcgtttaagagttcattggcttgctgtggcggtaaagaccaaactattgagcataaattttgttgatgtaaaggcaagaaagctaagatgctgtctttgttaaaaatttgtctagcacaattcttatgcgattcagaagtttttacgttgcaaactaaagcatgatgtccataatcacgaaaaatgagcggaatatctgcttgtttacgcacccaagaatttgctccgtcagcccctacaattaattttgccgatagcatttgtccatcatttgtggttaaaattgcattgttttcggtgagtcctaaatgatgcggaagtgcggtaataatttccacatttttttgcatttttaccttttgccaaagttgattttgaatcagatgattttcaataatatgccctaaatgctccagccctaaactttgtgtatcaaattgaatttgtgcaaaactatctttctcccaaacatccattttgtcgtatgctgtcgctctcaaattcaataaagcttgccaaacttccaagttttgcaacattttttcgctggctaaatttattgcactcacacgattactaagttgctcaatcggttctttattaggaaatccttcaattacagcaattttcacagggctatttcgcaagctggcagctaaagccaagcccaccattcctccaccaataattgcaatatcaaatattttcatcgtcattactccaaataaagataagtttaacaccagcctaacgttgctttagcaaaatactgtcgcaataaagaagattgagcaaatgccatcaagccaagattacgcccaatttgtagcggtaataaattattggcaaaaatagagactaaaccatcagttaaaccaataatattacgttgatcggggttgcgttgtttcgcatagttttgtaaaacttgatatttcccccaatcttgttgttgtaaataagcttgcgataccacatttgccaaactcattacatcacgaatacctaaattaaatccttgtccggcgaccggatgtaaagtttgacaggcattaccaactaaggcaacacgatcttgaatatgttgtgccgccttatataaagttagagggtaggcaaaacgtttaccacattctttcagttttcccactcgccaaccaaaacgttgttgtaagcggtttaaaaattgctgatcatcaaggtttattatttcttgactatttttgacgcaccaaaccaaagacattaaattgtttttcattggcaataaagcgattggtccttcttcggtaaaacgttcaaaggcacggttttggagaggttgttgtaccaaaatattactgataatggcggtttgttgatactcacgcacaagttcttgtgcaattcccaccgcacttgctacgttggattgagtaccgtcggctcccaccaataaatgagtgcttaaagtgcggtgatcttctaactgaatttttacttgttcaacatttcgttcaagagaagaaatagaaacgggggaaaaataatctatattgctacaatcctgcatagctcgcatcattaccgctcccgcctgatttaattcaatgacagcgcccagagccgcaagacaaaattctttagcagaaaactctgcaataccgaaatgccctcggtctgacacatgaatatgtttgataggttcacaaagaggcgttaataattgccacagcgattgcttattcggcaataaaatctgattgaaacgccggcaacttcctgatgataaagcaatacagcgagcatcaaagccaccgtgatgatgctgatgaggaatttgtttttccagtacggctatttttattttaccctgtgtttgatagctgagtgccaatgctaaactcgcaccggtcataccaccaccgacaattacaacatcgtagtgcaagtgcatatttttacccctctttcttcacttaaattattgttgcatcagattttcaatatcctcaatttcttttggtacagcagaggttaaaattttattcccattttcagtaatcaaaatattgtcttcaatgcgaacgccaattcctttatattgttccggtacatttgcctccgtaccgatatataaaccgggttcaacagtcaacaccatgcccgcttctaaagtgcggtctcgttttttactatttcgatctccgttttgcacctcactactgtagcttcctacatcatgcacatcaagtcccaaccaatgccctaatccgtgcatataaaattgacgataactttggttatcaattaaggtttgtacatcgccagctaaaattcccaaacgaactaaaccctccactttaattcttaccacttcatcatttgcctgttgaatactattgcctgccactaataactcaatagcacgtttttgtgcttttaatacaatttcataaatttctcgttgtgcctgagtaaatttaccgttgacaggaaaagtacgagtaatatcgcctgcatacatagcaaattcacaacctgcgtcaataagcaacaaatcaccatcttttaaaatttgatcattttcgttgtaatgtaaaatacaagcgttttcgccaccggctacgatactgttatacgcaacatatctagcaccgaaacgattgaagtgatgtagtatttcactttcgatttcatattcaaagcgattagggcgggtttgttgcattgcgtgaatatgtgccaaagcagaaatttgtccagcttgttgtaacaacgcaatttcattcggcgatttaaacaaacgcatttcgtccacaatatccgcccaatccaaaacttgtgcaaattgtgaggttcttctattcaatatatcttgtaaaaaatcagttccccaaggttgttgagctgaatggtaataaagtgcggtgatattttcactgagcagtaaaaaatgtgtttcaaattcggcaatatcataagccaaatccacagacaacgttttcggtgcattttcaatccctaaacgtcttccattccaagtttccattaaaggatcttttgcacgcaaaaataaaatactttctgatttcccttcagttttgcgtaaaagcaaaatactgtcaggttcattaaaaccggttaaataccaaaaatagctatcttgtcgaaaaggataatgacaatcctgattacgaattttttcttgagaggaaaaaataatggcaattgaattatcttttaattgtgccaatacttccttacgacgaaaaacaaactcatcatttggcatttttgccatataagtaagatccataaatactccttaatgcttaaaaaacacactgaattctagcataaaaaaacaagtcattcgattgattaaaaaacaaagctaatctatctataaacagcaggcaataagaaaacaacgcactttattaattgagcgagtttagctaaatacattgactaatgtaatacggttttctttgtttccgataatggtccgaagtgattaaagaataaaaaggtaatcgttctcacatattcaataatttcttctaatgctttagacaactcctcttgatcatctttttcatcatatccaagttgtccaatagcttgtaaatcatccagtgcttcgccgatttcgcctacctctttatttaaattaggctgatttagccctaatcctaataaaaaatggttggtccattccgacagagcatcagctcgagcaaaaacattatcttcttccggtaaccaaagctcaaaattaaatttatcaatatcggataaagtgcggtcaattttctgataaatttgttccacttctttcaataaggaagtgggatacgcatgatcatcatttgtaaattgataaagaagatactgccaacgttgatctgtaataccaccgcaaattaaaccggtaagaaaaccatgcaattcagccaccgttaatgcaatatttgcttgcttcagttgttgattaaattccgaataaataagaggtttttctgacatttgatatttccttgaaaaataatatgccagtttatcactgtttaacttcagcaaccaagaaacaaagggatttttatgacgaaaattttttgctatggcataataaggacacttttagcttttattataaaataggaaaacacatgtcaaagctcattgaattatccgtatcagggcaagtactacgtttaaattgtcctccggaacaacacgatgctttacgtcaagcagcacatttattagataatcgtgttatggaaatgagagagcgtaccggtattttacagatggaaaaaatcctctctatcgttgcattaaatttaagttttgaactgatgcaggaacaacaaaaaactcaaacaatcgaaaatgtcattaatcaaaagattgctcaactcgaaggatctttggagaatattttggctcaaaaaacaactttttaaacataaatctgtgatctaatcgtgataatttgaaaaatattctagccaataaaaataaattgcgttagtattgcactcaaagattacctgagatgtttgccggcggattaagtccctgagccgatactgaaaacttaatgaattggcgtcctgttgttggtgtgtatgcttgctagccatgcaagaaacctaaaaacaatattagccgattcccttgaaccgtagggttcaaggaccgaacatccgcagcggcatctcggggctattcttagttatccagccaatatattgtcccatgagtatttctaatcaacgtcaacaaatacgacaacttattcgagaaaaaagacaaaaactgaccgcacttgagcaagctcaagccgaacaaaatattgcacaaaaagccttggatgcgattgaaaagtttcgtgcggaacatattgccttgtatctttcttttgatggtgaaatttcaacgaaattactcattgaacaactttggcaacaagaaaaaaaagtttatttgcctgttttacacccattttctcccggaaatttattattcttagctttccaaaaagatacacctatgcactacaataaattcggtattttagaacctaagttgaatgtgcgaaatgtactgcctgtttcacatttagatttgatttttacgcctttagttgcttttgataaggatggaaacagattaggaatggggggaggattttatgatagaaccatacaaaattggcaaaaaaaatcttttgtccctgtcggattagctcatcaaattcaagaagtagaacgactccccattgaaagttgggatattcctttagcagagattttaaccggataatgaacgcttaaaacgtttacggcggcgatgaaaattcgccgaagcggtacttttttttattgcatgagtaataggcatcatatcaggcgttttttgtcttgtgcgacgatggtaattcaaaaaataatgaatggaattcaccaataaagcactagctaaaaatagaatgattaattcaccatataactgattaaaaatgtggtttattttacgctgacttgcttgtctatatttcatatcaagagtaatacgtaaaaaaccctcaataccattagatgaataaatcggttcaacaatttgctgaatattcggttgcgtagtattgttcgctttttgatttaagttcaatttatcacgcaaaccgacaaaattcgcactatgtgctaacaatttaccgttagcaccataaacagaagcatcaatcacaaattcttctttcgtaaagtcgttcagttttttggtcaaaaggtccgaattggggttatccgcaaaaagcatagcaaaaagattagcttgctgacgcactaataaattggataagtagttcatttgattaattgttgctaattgtgaccctaatttaaacttattaatcccaaataaaatcaaagacataatagttagacaaagcaaaataatgccgagcaacattccaatttttagtattttttcttttattaagctcaagttattttccctaaaaattattaaataggctagaataagaacaaagaaataatttacaggatcttttatgcaaactcaaaacctagagacaattatctctcattatacgctattcccttccccaattttatcagaaaaacccactgtacttggagaagattacttcattctctatggtaaaaatttaaatttggacagtttattaacttttcaacaaaagtgcggtgaaaattttctgattttagattgttggaatcggttagattacactgttgccttattcaaaagcaattggcaatcgcagtacttaactgttgctcatcaactggaacttgatattgcattattaaattttgatgctcgtttaagtcaagcgggattattagttatggatatggattcgacaattattcaaatggaatgtattgatgaaatagccaaccttgccggtacaggaaaattagtaacctccattactgaacaggctatgcgtggagaacttgattttgaacaaagtttacgtcgtcgagtagaaacgcttcaaggagcacctgaacatattttacagcaagttcgtgatagtttacctttgatgtgcggtttaaccgagatgttggaagtgttacaaaaatatggttggaaaattgccattgcatcaggtggatttacttattttgccgatcatttaaaagaaaaattaaagctggattatgcggtttccaatcacttagcggttgagcatggttttctcactggaaaagtacaaggtgatattgttgatggagcatataaagcggaaacgttaaaatctttagctcaaaaatggaatatagatttaaaaaatacagtagcaattggtgatggtgcaaatgatttagccatgatgaaagtcgcaaatctaggttgtgcttttcatgccaagccaaaagttcaacaacaagcacaagttgtggtaaactttgccgacttaaccgcacttttatgtattttaagtgcaaatgatcggattacaaaaaattaaaattgaggagcatattatgccgtcatttgatattgtttcagaaattactctatatgaaatacgcaatgcagtagaaaatgcaaatcgtgtattaagtacacgttatgattttcgtggtgttgaagctacaattgagttaaatgaaaaagcagaaaccattaaagttacgactgaatcagatttccagttagagcaattaattgaaattctaatcagttcctgtgttaaacgtgatattcaacataattccttggatattccggctgatagcgagcatagcggtaaattgtatagcaaagaaattaagctaaaacaggggatcgaaacagacatggcaaagaaaatcatcaaattaatcaaagacgcaaaactaaaagttcaaacccaaattcaaggtgagcaagttcgtgtttcaggaaaatcaagagatgatctacaggcgactattcaattagtaaaaaatgcggaattaggtcaaccgttccaatttaacaatttcagagattaatttctatttttcctacagaaaccgccaacaatataattgcacatattattggcgtttttttgtattcaaattattacagtattcttaaacttcaatactagtgtaatttaaagctaataggtactgtaatttggcttggtagcccagcaggtttttgcccaatactgcgtgcactttgaaccgcacttaatgctgccttatccaaatcttctgaacctgaagattttgcaatacttatttgacttaagctcccatcagcaccaatagcaaaactaacagtaacaatcccttgttttcgcatcatttttgcacgttgtggataacgtttatggcgttcaatttcacgacgcaacgcacttttataagcagcaacttcatcagtactatttcctgttccaatcaaattcggattagatgttgttactccgcccaagcccatagcctgcgaatttactttatcgtcagaatcaatatccctatcacctttaggtaaatcttttggctgtttttgttttgtgcgttccttaggtttcttcttcggtttttccttcggcttatctttcggtttctccggttcttttaattttttctccggctcaggtttaattgttggatctgcaactacctctgttactacaagatccggctcaggctcagctaccggttctggcttagaatcatctacaaccatacccattaacatttccattgagatctcagtaccaatcaaatccgcactatatccatttgcactgtcatctggtttagtaaaccaaaaaaaaccgccaattaatgcactatgaaatacaagcgagaagaaaaaaccaaaccaagaatgatatttcttcattacttacttgccttttctttcatcgttacaatagcaacatttttaatttcgttttttgccataatatctgtcaaggttacgaaatcttggaaagtagatttagcatcgacttttaatgtcactttttgctctttgtcccaagtcgcaatttcttgctccagttcttctactgaaatgggcttatcattaaaaaaaatctccccttgctcagttactgtcaataattttgctagatcatcggacttgaaagcaactgtgctacttgctttgggtacattaacttgaattttcccttgagaaataaaagaagctgtaattagcacgatggcaagaagcaccaacataatgtcaataaagggaataatattaatttcatcaaattttttcacattactcaccaatattttgctgactgtttaaggctttccattttagacggttaacttcaactttacgtcctaaaccgttgtaaaataccatagaaggaatcgcaacgagaataccaactgcggttgcttttaaggcaagagataagttaagcatgatagcagctgcatcaatgtctcctcctgagttacctaattcatagaacgttaataaaattccaattaccgtacctaataaaccgacataaggtgcattagaaccaattgttgagataatggtcaaatgacggtttaaatcaatatctaactcatgaatattcgtgtaactttccactttaattttggtcagatacataaaacgttcaacggaaaaccataacataataaaactcattacaccgagtaaacccaaaatgatgtagtcaatataatgatgtaaaaaattaaaaaactgtgacattggataacattccttgctgataaaaattacaaataagttattgagaattaatttcaattagggtgaggattttaacaaattttattgagagatcaagctataatattaaaaagagactttttgagtaccgcacttttccatctgttttttattttagtgaaatttgacgtttttcgttcatactatgataaagcaattagaagaaatgactaattgaaatactgaaagataagacactagtaattgacatccccctgccttaagaccgggcggatatcaatttctcaaaaattggctgatgactaattctacgcaccatgcgatgatttcatcattctctgccatttgtattgctttttctagtttttcaaaggcttttcgaaatgagagaatctatttaaatctttttttcgcttcagctatcgcttcagctacacgtagtggtgaaactccgccttttgcacaacgtttatccaaacaggattgtaaagataagatttcataaacatcctcctctatagcattactaaattgatggaattccttaatacttaaatcttctaaacctttatgtactttaatagcataaactactgtttcacccacaatatgatgagaatcacggaaaggtacacctttggcaactaaatagtctgctaattctgttgagttagaatatccctttaatgccgcttcttttgttctttcaacgctaactttaatatcttctaacacaaaagtcgccatatctacacaatcttgccaagtatccaacgcatcaaaaattccttctttgtcttcttgcatatctttattataggcaagaggcaggcctttcactgtcatcaacataccggtcaaagcaccgacaactcttcccactttgcctcgaattaattcacaagcatcgggatttttcttttggggcattaatgaagaaccagaggttactcgatccgacagctccacaaaatcagcctctccactattaaaaatgatcatatcttcagcgaaacgtgaaagatgagccatacttaaagacgcagtggaaagaagttcaataatatgatcacgatcagatacactatccaaactatttctcgttgccatcgcaaaattcagatcttgtgcaagtaaatcacgatcaatggcatacgcagtaccggctaaagcaccactccccaaaggacaagtattcattcgttgataagcgtcttgtaaacgaccataatcacgatccaacatttccacataagccatacaccaatgagcaaatgtgattggttgagcacgttgcaaatgagtataccccggcattactacgtgttgattatgctctgctgtctctactaatttacgttgcaattcacgcacggaatgctgtaattcagtaacacgttgtttacaccacatcttaatatctaatgcaacttgatcattacggctacgcccagtatgtagttttttgcctaagttacctactttatcaatcagtttactttcaacccaactatgaatgtcttcagcatcatcttgtaaaatcttttgtggatttgaccgcacttcaattagtagttcactcaatgcgttttcaagaacttgctgctcttgctgagttaaaacatttacggtaaccaatgctttagaccaaccgattgaaccctcaatatcttgttcagctaaacgatagtcgaaacgcaatgagtcgttaaaatctttaaaacgtttatctgtcgcttgtgtaaaacgcccaccccaaagtgccataatcacatcctttttctgttattatttgtggataaatttagttctcattatctcacacaaagaaaagtgcggtcaatttaaccttcacaatcccttcttaatattaccgctgactgtcatattgatactaaacgactctactttttgacttgattttcgcttgtgttttcttattgccatccagtacgacatttttctgcttattcggttaaagttaagagttttgatttaaattatgcgttacattatttaaaattactggaatgtgtcatcacatttagatgtttgattcaagcaagaggaccttaatgtaatttatttagatcaatagtgcggtagaatttaagatattatttaataataaagggtgataggtttatcatgaaaaatttccgttggtatttaagttatagggcgggaagatttaaacattattggagaaatgtgcagtgtcaaatttatgtagaaacataaaggttttttttaaagtttttttgtatcgctttaaacaaaataaattaaatcaagcagcaggctatttaacttatagtactacgctggctcttgtgccattgattatggtgtttttttccgtttttgcggcgtttcccgtttttaatgaaataaccggcgagctgaaacaatttatttttactaattttgccccttcaaccggtgatgccgttggagaatatattgatcaatttgtcaataattccaaacaaatgagtgcggttggaattattagtttaattgttgttgctttaatgcttattcattctatcgaccgcactttaaactcaatttggcttgatactagtgtgcgtccagcaatattttcctttgcaatttattggctaattttgacgcttggtccgattgttattgcgacgagtatcggtattagtacttatgtgactaaatttgcaacctatacatttgaacaagatttgggtttatccgtgggtataaaacttcttagtttgatgccgtttttcttgacatggtttatttttaccgtgttgtatatggtagttccaaacaaaaaagtgagtattatacattctgccgccggtgcattaattgcagcagttttctttacattgggtaagcaggcttttacttggtatattacaacttttccgtcttatcagttaatttatggagcaatggcaacgttgccaattatgttgctttggattcagctcagttggacggctgttttattgggggcacaactttccgccgtgttggcggatatgcgttcacttgatgacagtaatattcaaatagaaaaaatgaaggaagaaaaatgattgcattaattcaacgtgttagccatgccaaagtggaagtcggacaaaatattgttgggcaaattggacagggattgttggttttactgggtgttgaaaaagacgatgatcgaagtaaagcggataagttggctgaaaaggtgttaaattatcgcattttcaccgatgaaaacggcaagatgaacttaaatttacagcaaatcggtggagaaatattaattgtttcgcaatttacgcttgctgcagatacgcaaaaagggttgagaccgagtttttccaaaggtgctgatcctgagttggctgagaaactttaccaatatttcagtcaaaagtgtgcggagaaagtgcgggtcgcaaacggacaatttgcagccgacatgcaagtgagtttaactaatgatggacctgtaactttttggttaaatgtataatataaaaataccgagtgttatgctcggtatttttatttctatttgaattaaaggaatttttcttttaattcttttgcgacagcaagttgtttttcagtcgcttttgctgtcataggttcacggcagtaacctgcattaacaccttgaagtttaaggatttctttaatagttaaatataaaccgttagccagtataccttcgattaagtcatttgtaacatgttgaatctcaagtgcttcagcaacttttcccgcttttgccaattcaaatatttgtcttgcacgtaaaccatttacattaaatgtactaccaattgcaccatcaacacctaaagagactgctggcaacatcatttcatcaaatcctgcccaaactagatggtttggataggcttttttcaagcgttccaataggtagaaatcaccggcagtaaatttaactcctaatactttgggattggcatagagttcaccgaattgctcaacacccatattgacacctgttaagaatggaattgagtaaacgatcatattgttgccggtttcagcaataatcgtttcgtaataatgtttgatttcggcaaagctgaatttgtagtagaacggcgtgacggcggataagctgtcgtagcctaattctgttgcatatttacctaactcaacagcctcgtgtaagtttacactaccgacttgagcgattaatgcaacttgatcttttgcttcctctttggcaatacggaaaatttcttttttttctgcagttgagagcataaagttttcgccggtactgcctccgacatataaaccgtcaattttcattttatcaatgttataacgaacgatctcacgtaaacctttttcatttatggaaccgtcttcgttaaaagacactaataatgcactaaaaataccttttaagtttttcatttgtttctcctgatataaaagggattaaatttttatttaatacgttgttctaaaatcacattaactgttttttgtttagtttgtaccgcactttcttcttccgcttgaacaatcaaggtgtaaattaagtccaatacaaaaagttgagctatttttgtaccgatagaatcgccttgtagctgcccttgtcgattaccgttgattaatacataatcagaaaccatagtgataggggagcgtaaattatgtgtaagagcgacggtaacagcaccgtttttcttggcaatattcaatgcttgaacggtttctttggaatagcctgaatgacttataccgataacaatatcacttgagttcattaatgcggcttgcatatacataaaatgattattgcttgttgcatcaacgtgtaatccaatacgcattaatttattttttgcttcttctgcagttaagcctgatgaaccgacaccaaacaggaagattcgttttgatacacgcattaattcaacaactttttcgagttgagcaaaatccagcaaattaacggtttctgaaatgacattatgaatgacattttgcaatttttctgcgatttggcttgttccatcaaattttgatatatccgtttccagtagagaattagattgtcgatcttttgtagccaactcaatcgaaagttgtaatttgaaatcagtaaagcctttaaaacctaatgttcggcaaaaacgaataaaggttgcttctccgacatcgaattgttgtgcaatttccgctaaagagttttgtcccaacaactctggagaagatagaaccgttgtggcaatccgtttctctgtttttgttaggctatcatacaaagcaccaatggtatccaatatattaccgctcgttgccgccataattgagcctcttgttaatgttgtttgtttcttgatcaattagtgatacaggtattttaacgactaatttttttaactcagtagcttgaccatcaacattacagcaaggtttgtgcggttcgtaagggaaaaaaacggcaaacatttttgggcgtaatgttaccgcacttttatgcggaatatcatcaattaactgataatcgtcttgctcattataagcggtacagtctgctaaatttggatattcaacaccatattcaattgtttccgcaccggaaattaatacttgaatatcaatatattgatgatgcaattctgcttttttatcttcagaagccacagtcgttgactccatgacattcatataaatttgatcggttaaatcatgtcgacctgtggtcaaattttctaaatctaatgtattaagatgattgcaaatatcgaccattacttgtggtaagttacgcttaaaatcatctcttgttaaatcaccaaaaatcattttttactcctattattatggggtttgttgcattttcatccaataagccgcaccaattaaacctgcatcggcaccgtatttagccggctccaaaatacagtgataaaattttggcatgtcggttaaatattcttgaacgagggataagtatccctcagctaatccaacgctaccgcctaaaacaaccttttgcacatctaaactaatcaccatatcagcaattaagttagcaatagcttttgctgaggatcgaacaagtgcggttgctttttcatcatttttacggaacaagttgaacacttctttcggattacaaggcttttcccacttattcgcctcacgttcaattgctcgccccgccgcaatcgcttcaacacaaccacgacgaccgcaaccacaaattggaccgttcggatctgccaaagtatgcccgatatgaccagctataccatttagcccagtggataattttccatcaagaataattcctccgccaacgccagttgataccgtgataaaaataaaatttcgtaccgcactttggtcttgatcttggtactctgcacaaacagcagcctgtacatcatttagcaagccaatcggtttatctgtatggagagcaatgcttttttgtaaggggaaatcaaccagtccaccgagatttttaggattaagtgcggttaaaataccgttgttgatgatgcctgtcgatgcaaccgcaaccgcatcaaactgtcccgaataactttgcataatttgctcgatggcatgatgcaatgcgactgtaggatctgcttgtggcgtgctgatttgctgacggttagagagcttcttttcttcaacaacagcggttgcaatttttgtaccgccaatatcaattgctaagcaacgcatacttttttccttaagtttagtaggatttagctgatttaaccgaggtgacaaaccagcttacaatatgttctaagcgagtcaatgccgaaccaacagtaacacaatcagcaccaatttcaatggcggctttagccagttccggtgtgttgtaacgaccttccgccatcacataacaaccggcggcttttaaatctttgactaattgatagtccggttcttcgggaatatcgccgccagtatacccggacattgtgcttcctataatatcaaagcccagttgttggcaatataaaccttctttcagatttgagcagtccgccatggctaaacaccccaattcgtgaatttttttcaccgcacttttaatgtcaacaggacgtttgcgatcggtaccgtcaaccgcaataatatccgcacctgctgctgctaagtcttcaatatcttgtagaaacggtgtgatccgcacagggctgtcttctaagtctcgttttacaattgcaataatcggtacattcactgcaggacgagttgcttttaagttatctacgccttcaatacgcaagcctgcggcaccaccaataatggaggcttgagccatcgctgcaacaatttccggtttatccataggaccgtcatctacgggctggcaagaagcgatcaatccaccttgaataacggttaaaacttgtttctgtgataatgttgacatataaaactccaaactataggaataactgaacgttattccttttctttataaatattgcgttaatttacgggttagtacctcgtaacctttcggattgaaatgtagaccgtcagtacataaagttaaatctaattttccgtctttacccacaaaatcctgccaagtatcaataaatgttaaacgttcaggacagttttctcgtaaatagtcatttaacgccataatggaagagttatctgttgtagcaatattatttaccggtgttgcttccaatagaaagaattcggattcaggggaaattttgactaaggcttgccaaatatcacagatccaatccaatactttggcgtgagaatactcaggctctttaacaatgtcattcacccctaagaaaataaagacttttttacctaaatagttaatcaattgaggtttgataataacatctaaatattgtctagcactgacacccgaaatacctaggttggcaacacgtttgcctcttagttgaatttctggtgaaatatcactccacatatcaaagagtgagtgtccaactaaggtaatatcagcttgcttttcaaattccgcttttttaacttgataacggttgaaaatatcttgatctgtcagcaattgtcggtccttaatttaacaatattgattaatattggaacgaattatataaaaattgaattttctcgcaatgttatttggtgttttactccagaatttatttaaatttgtgtgccacgtcacaattctgaaataaaactctataaatatattttaaaatgattttttgcttttagaatatactttcagcaacagtgcttttcccttcatatttttaataggagaacttacgatgaaatttgaaaaactcgctcttgcaactttagcgttgagtatgtctgcctctgtttttgcagcagattatgagctgaaattcggtatggttgcaggtaccagttccaatgagtacaaagcggttgaattttttgcgaaagaagtaaaagaaaagtccgatggtaaaattgaaattgcaattttcccaagtgcacaacttggtgatgaccgtacaatgttaaaacaacttaaagacggttctttagattttacattaggtgaaactgcccgttttcaaatcttcttccctgaagcggaagtgttcgcattgccttatatgcttccaaactttgaaatcagtaaaaaagcattacttgaaaccaacttcggtaaggggttggtccaaaaaattaataaagagttaaatcttgagttattgtctgtagcttacaacggtactcgccaaactacatctaatcgtgcaatcaacagcattgcagatatgaaaggcttaaaattacgtgtaccgaatgcggcaactaatttagcttttgcaaaatatgtaggtgcttctccgacaccaatggcattctcggaagtgtatttggcgttacaaaccaatgctgtagacggtcaggaaaacccattaccaactgtccaagcacagaaattctatgaagtgcaaaaatatttagctttgactaaccacatcttaaacgatcagctttacttggcaagtcgtgaaactttagaggatttaccggaagatttgcaaaaagtagttaaagaggcagctgagaacgcagcagagtatcacactaaattgttcaaagagggtgaaaaaaatttagttgcgtttttcaaagagaaaggtgttactgtaactactccggatgtaaaaccgttccgtgatgcgttaaaaccttactatgatgaatacttaaataaaaatggtgcgttagggaaacaggcaatcgaagaaatttcaactctcattaaaaaataaaaaatgccctttccctagtgagggaaagggatagcttttttgttcggagtatgtatgaaaataatgaacaagttagaagaatggattggcggggcattattccttgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgccgctgacaatcaaacgtatggcgatgacctttgttcaattattaatttttgtctcaattattctgtttatctacttaggttatggcgtttgggcagacgcaacttttcctatggaagcattaaaagctacctttggaacggaaattacgcaaaaatggctctacgcagggttgccgattattgcatctttgatgttattccgttttttagaagctcaagcagaaaactttagaaacaaagtcacttacttgcctgtttcttttttccttgtaagtgcggtcattatttttgcgattttatattttcagccggagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaacactggcggtatcactgagcgtatcttccacttcgcaaaaacgttattaggacactataccggtggtatgggacatgtaaatatcggtgccagcttaattttttcgggtatgtcaggatctgctttagcagatgctggcggtttaggtcaattggaaatcaaagcgatgcgtgatgcaggctatgatgacgatatttgcggtggtattactgctgcttcctgtatcatcggtccgttagttccgccaagtattgcaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgccgcatttaaagacacattttgggcaattttgacaccgtttttgattattggtggtattttctcaggtttatttacaccgacagaagcggcggtcgttgctgctgcatattccgtaattgtaggaaagtttgtttataatgatttgaatctaaagaatttcctcaaaagctgtgtagaagcagtatctattaccggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggtcatgactacattaaatatgatgattggtattttaacccctccaatgggaatggcattatttgtcgttgctcgggtgggtaatatgcctgtaagtgtggtagcaaaaggtgttttacctttcttgataccaatttttatgaccttagtattgattacgattttcccacaaatcattacatttatacctaacttgctaatgctttagcagtaaaactggggattgaaaagatagaagtcggtttatgatcgacttctgaagaaatctatttttcaatgtgtatctggataggtatttatttttactcaacttaaataagcaattaagcaataatgttctatattatcatttgataaattaatttatcttaataaaagattaccaatcaatacaaaactcctgtacaatatctcggctttatttttccgcttagcgtgcggctaacgaaaataattttagtaaaagtaaagagcggtggtttttaagattatttttgctagtcgcaaattggaaaatagagcaataagattaacttactaatttataaggaacatattgtgaatccaattgtaaaacaatttaaatatggtcagcacactgtaacattggaaacaggtgcgattgctcgtcaagcgacagctgctgtcatggcgagtatggatgatacctctgtttttgtaaccgttgttgctaaaaaagatgtgaaagaaggtcaagactttttcccgttaaccgttaattatcaagagcgtacttatgccgcaggtcgtattcctggtggtttttttaagcgagaaggtcgtccatccgaaggtgaaacattaattgctcgtttaatcgatcgtccaattcgtccgctctttccggagggatttttcaatgaaattcaaattattgctacggtagtttctgttaatccgcaaattagtccggatttagtggcaatgattggtgcatcagcagctctttcattgtcaggtgtgccatttaacggtcctatcggtgcggctcgagttggttttattaatgatcaatttgtgttaaatccaaccatgaatgagcaaaagcaaagtcgtttggatcttgtcgttgctggtactgacaaagctgtattgatggttgaatccgaagcggacattttaactgaagagcaaatgttggcggcagttgtttttggtcatcagcaacaacaaattgttattgaggcaattaaagagtttgccgccgaagcaggtaaacctcgttgggattggactgcaccggaagcaaacaccatattgattgaaaaagtaaaatctattgctgagaatcgtttaggcgatgcttatcgtattactgaaaaacaagctcgttatgaacaaattgatttgattaaagcggatgtaattacgcaagttacggcagaagatgaaacaattagcgaaggaaaaattattgatattttcaccgcacttgaaagtcagatcgtacgtggtcgcattttaagaggtgagcctcgaatcgacggtcgtacagtggatactgtacgtgcattggatatttgtaccggcgtgttacctcgcacccatgggtctgcgatttttactcgaggtgaaactcaagcgttagccgtagcgacacttggtaccgagcgtgatgcacaaattattgatgaattaactggtgaaaagactgatcacttcttattccattataatttccctccatattctgtgggcgaaacagggatgattggttcgccaaaacgtcgtgaaattggacatggtcgtcttgctaaacgtggtgttgcggcagtgatgcctagcttgtctgaattcccttatgtagtacgtgttgtttctgaaattactgaatctaacggttcttcttcaatggcatcggtatgtggagcctctcttgcattaatggatgcgggtgtgccgattaaagcggcggttgcaggtattgcaatgggattggtgaaagaagaagataattttgtcgtactgtccgatattttaggcgatgaagatcatttaggtgatatggactttaaagttgcaggaactcgtgaaggtgtaaccgcacttcaaatggatattaaaattgaaggcattaccgcagaaattatgcaaatagctttgaaccaagctaaaagtgcacgtatgcacattttaggcgtaatggagcaagcaatcccagcaccaagagcagatatttctgattttgcaccacgcatttatacaatgaaaattgatccgaagaaaatcaaagatgtaatcggtaagggcggtgcgacagttcgttctttgactgaagaaacaggtacatctattgatattgatgacgacggtacagtaaaaattgccgctgtagataaaaacgccgttcaggaggtgatgtctcgcattgaagatattacagcagaagttgaggtgggcgttgtttataaaggtaaagtaactcgtcttgcggactttggtgcctttgttgctttagtaggtaacaaagaaggtcttgtgcatatttctcaaattgcggaagagcgtgttgagaaagtgagcgattatcttgcaattggtcaagaagtaatagttaaagttttggaaattgatcgtcaaggtcgcatccgtttaactatgaaagagttggcgaaagaccaaactaagaatgaagaaaatcttctgcaatcggaagagggttctccggttcaagagtaaatttgatagagtaacttgaagggcaaattatatttgccctgtactgtatctgattactttcatcaatatagtgttttaaatgtgctatccattgaaatttaatcaataatctttttgtttatcttcattgttatttgaacaatattgaaattttgaatgaagccatttatccagcaaaacaagactcaatataagcaagcaaataaagcttgttgtttttaattaggcatatatttccgttgggtatcgttttgccgaacttgtaaaattgattgacaagtaaataatccatgatgaatgaactcaaacatggattccgtgttgtgaaacgagctttacaacgattaattaacctaaggcaaaagcatattgagctttcctttttacattcgagtatttttaatgactgaaacaacaattacttttaatgatttagggttacctgaattcatccttaatgcagtgtccgaaatgggcttttcaactccttccccaattcaacaggcttgtatcccgcatctattaaatgggcatgatgtgcttggcatggcacaaaccggtagtggaaaaacagcggcattttctttgccattattggcgaaaattgatactaatgaaaaatatccacaaatgttagtaatggcaccaacccgtgagttggctattcaagttgctgatgcttgtgaacagtttgtgaagttttctaagggggtgcgtattgttactctgtacggcggacaacgttacgatattcaattaagagctttaaaacaaggtgctcaagtggtcgtcggaacaccggggcgtattttagatcatattcgtcgtggtacattggatctgtcaaatttacagtctattgtattagatgaagcggatgaaatgctacgcatgggatttattgatgatgttgaaaccgtcatggcggagcttccagagcaacaccagaccgcacttttctctgcaacgatgcctgctccaattaaacgaattacaaaacgctttatgcacaatccgcaagaagtaaaaattcagtcaacacaacgtactgcaccggatattacgcaaagctgttggtatgttcgcggttttcgtaaaaatgaagcattgttgcgtttcttagaagtggaagattttgatgctgcaattatttttactcgaactaaaacagctacattagatgtcactgaattattggaaaaacacgggtttcgtgcagctgcattaaatggagacatgacacagcaattacgtgagcaaacattagatcgtcttcgcaatggaagtcttgatattttagtggcgactgatgttgcggctcgtggcttagatgttgaacgtattagtttagttgttaattatgatattccgctggatgcggaaagttatgttcaccgtattgggcgtacaggccgagcaggtcgtgcgggccgtgcgattttgtttgttgagcctaaagagcgtcgtttattggggaacattgaacgcttaatgaaaaaagcaattgaagaagtggaaatgcctaaccatcttgctttacaagaatgtcgccgtaaaaacttcgtggctaaaatcactaagcaattagaacatcatgatctagaacaatatcgtagcttattggaagatttatttacggcagatcaggatcaggaagacattgcggcagctatgttgatgttattacaaggcaaacaaaaacttattcttcctgaagatccggtgtttgaaaaacattcacgacgtaatgatcgtagagagagaggggagcgtcgtggtaaagaaaatccacgttctgagcgtcatgggtatggtattccgcaaccaatggatttatatcgtattgaagtcggtagatgtgatggtgtcgaggttcgtcatattgtaggtgcaattgcaaatgaaggggatattcaaagtcgttatattggacatattaaactttatgacacttattcaacgattgaattgccacagggcatgccaaaagaattgttacaagtatttgctaaaacgcgtgtattaaataaacagatgcgtatgtctttcgtaagtgcggtcaattctgaggaagagtttgaagctggctcaggtggtaaacgaaaagggcgttatgaacgtgagtttcgtggtggacgtaaatttaatgaaaaaagtaaccgctctttttctgaacagcgtaaagaacgcagagaaagaaagagataaaagcaaaggggctattacagccccttctttctgataaagcaaataattaataaaaattttattaacgactgcggaaaataatacgacctttactcaaatcataaggtgtcatttcaaccgttactttatctcctgttaaaatacgaatatagtttttacgcatctttcctgaaatatgtgcagttacgacatgaccgttttctaattccacacgaaacatcgtatttggcaaggtttctaaaattgttccctgcatttcaatgcaatcttctttagccatttattcctctaaatatgaatgaaaaaataaaaacttcgggattatactctattaatgagaaagacgaaaagaatttattctattaaagggatattatttttatttagctaatattgaaaaatttatcggattgaaaaattgtatttactgactaaaaagattagtatttgactgaagttatactatattttttattaaaaaggataatctatgacaagaattgcaattattcccgctagggcaggttccaaaggtattaaggacaaaaatctccaattggtaggcggtatttcattggtcggtagagcgattttagcggcacaagaatctggtgtgtttgatcaaattgttgttaattctgatggtgataatattctcaatgaggctgaaaggtatggtgcgaaaacatttttacgtccttctgagctggcacaaagtgatacgagaacgatagatgttattttacattatttgaatgaattaaagattgaaaaaggaagtgttactcatcttcaacctacctctcctttaagaagcggaatagatattcggaatgcaatggaaattttttcaggagggtgtaaatcagttatatcagcttgtgaatgtgaacatcatccttataaatctttcattatggaaaataatgagattattccacatagagaaatcagtgattttgaagcacctcgtcagcaattacctaaagcatatcgagcaaatggtgctatctatattaatgatattgaagcactattaaagaacaaatatttttttattcctccaataaaattctattttatgccaactcattgctctgttgatattgacaatacgctggatctgcaaattgcagaaaaattaattcaaaatcaatattagaggttatatttttaaggataaaaatcagcgagatgtgtcgattattcgctatgctaaaattacgctgtgttagcaattttcaaactttgatttatatttggaaaacatgaacattctcattacagggggagccggatttatcggctctgcgcttattcgttatctactgactgaaactgaacatactatcattaatgtggataaattaacctatgcggccaaccttgatagcttacaaagtgcggtgctcaatccacgttatttttttgagcaagctgatattgttgatcaacctgtgataactcaaatatttgagcaatatcagcctgatgcagtaattcatttggcggcagaaagtcatgtagatcgctcaattgcagcaagtactgaatttattcaaaccaatattgtagggacatttgctttgcttgaggttactcgtcattattggcttaaattgcctgcaaataaaaaagagcggttcgtttttcaacatatttctacggatgaagtttatggtgatttaattgactctgaacaggcttctactgaaagtagcccttatcaaccaagcagtccctattcggcttcgaaagcagcttcggatcatttagtaagagcatggtatcgtacctacggtttacctattctaattacgcattgtgccaataattatggaccattccaacattcggaaaaattaattccacgtatgattttaaatgcagtgaaagggaaacctttgcctatttatggagatggtttgcaaattcgggattggttatttgtagaagatcatgtacgggctttatataaagtattacaaaaaggaaaaatcggagagagttataatattagtgcaaattgtgcaaaaaccaatctagaagtggtgcagacaatttgcgatttattagaacagttagtaccaaataaacctaaaggaataaagcaatatcatgagttgattattcatgtcgaggatcgtcttggtcatgataagcgttatgccattgatgcttacaaaatccaaacgtctttgggctggacacctttacaagattttaccgccggcctacgtaaaaccgttcaatggtatttgaacaatggaaattgcagaaatggttaagactgttagttaagcagagtagtgatacacacaacgacaggtttaatatttcgtatgcagtatgtaaaatagctaatcattaagaggtatatacaagggttaaataaaaaacgttacataaaaattaaacaaaaaattaacaaaagtgtgatttttgtcatatttttgtaacatcaggtttattttttcttctatttttgtttacaattcacatcgcatatatcgttgcaattatatcttataatttatttactggagtaagttttatggccctctttttgagtatctttcctatcgttttattaatttatttaatggtaaaacgtaacgcattaccttcttatttggcattaccttggattgccgctgttgtattaattattcagttagttttcttcggtacagatattaagattgtgagtgcaaatattgcatctgcacttgtagcagttcaaacacctatcactgttattttaggtgctattttattcaatcgtttctctgaagtatcaggtgcgacgaatatattacgtaaatggcttggtactattaacccaaatccggtggcacaattgatgatcatcggttgggcgtttgcttttatgattgaaggggctagtggttttggaacgccggcagcgattgccgcacctattcttgtcggtctagggttccctgcgattaaagtagctgttttgacacttattatgaactctgtgcctgtgtcattcggtgcggtaggtacaccaacttggtttggttttggtcctcttcatttgggcgacggtcaaattttggaaatcggtgctatgacagcattaattcacgctttcgctgcattggtgattcctttaattgccttaagtttcgttgtaagcgtcaaagaaattcgtcgaaatattatctatgtttatttaagtgtatttgcttgtgttattccatatattttattggcacaagtaaactatgaattcccgtcattagttggtggtgcaatagggttacttatttcaattctacttgctaataaaggtattggcttggctaaggttgaaaataatattgaagctgcggttccttttaatgacgtagtgaaagcattgtttcctaccgcacttttaattgctattttgattatcactcgcctccaacagttaccgttcaaagcgatgatgaacgatgcgacaacttggtttgcggttcaattgggttcgttagggcgttttgaaatcagtcatggtttaattttcagcctgaaagacattttcggtacatcaattaattccagctataagttattgtatgtgccggcactgattccatttgttgtaacagtattaattgctattccggtatttaaagtatcggcagcaaatacaaaagatattttcgttaccagcttccaacaaactaaaaatccattctttgcacttgtcggagcattgattatggtgaatttaatgttagtgggtggagatggttcaatggtgaaaattatcggtaagagtttcgctgctgcaacaggagagtattggacggtcttctctgcttatttaggtgctgtcggagcatttttctctggatccaatacagtatctaacctgacatttggtagtgttcagttatcaactgcagagttaaccggcttatcaacttcattaattcttgcgttacaatctgtcggtggtgcaatgggtaacatggtatgtattaataatattgttgcagtaaattcagtattgaatatccaaaaccaagaaggggcaattattaagaaaacagttattccaatggtaatatatggtattattgccgcactggttgcattgtttgttatcccgatttttttctaaataatgtatacttttggtaagcagtattctttgatgctgcttacttttatttattttaaattgaaatattggagttcttatgaatgtaaatttttatgtcacttgtattgccgatgtggttaaggcaggagtggcaaaaaatacagtgttgttgctagagaaactgggttgtaagattatcttcttagaaaagcaaggatgttgcggtcagcctgcaatgaatagcggctatacgaagcaagcattggaaggaatgaagaatttagtgtcaacttttgaagtaaatgattatccaattgttgctccggcaggatcttgtgtttatgcaattaaaacttaccctgagcaattttctcgttttggtgaaactgaatgggcggaaagagcacaaaaagtggcagatcgctttcatgatctcaccgattttattgtgaataaactaaaagtaactaatgtcggtgccaaattaacgggaaaagctgtttatcatccgtcttgtagcttatctcgcaaactgggtattgtgaatgaacctttaacacttttgcaaaatgtaaaaggattggagcttttacccattaccaatcagcaaacttgctgcggattcggtggtacattttcggtaaaaatggcagaaatctccggagaaatggtcactgaaaaagttgagcatattacagaagttgaacctgagtatttaattggtgctgatgtgagttgcttaattaatattggtggaagattgaaccgagaaggcaaaaagattaaagtcatgcacattgctgaagtattaatgcaggaggataaataagatgtcactaaaaaccagtaatcttgcatttaaacagcgtgtggacaatcaaatccataatgaaatgatgcgtaaagcggtagttaaagctcaagaaactatcggtgctaaccgtcaaaaaatggttgatgaattggggcattgggaagaatggcgtgatttagccaaacaaattcgtaatcatgttttagcaaatttagatgcttacttatatcaattgagcgagaaagttcagcaaaatggtggaaaagtttactttgctgaaaccgctgaagaggctactcaatatattcgtcaagttgcgttagaaaaaaatgctaaaacaattgttaaatcaaaatcaatggtaactgaagaaatcggtttaaatgaagtgcttgaaaaggaaggcatgaaagtcgttgaaactgatttaggcgaatatttattacaaattgttggagataaaccttctcatattgttgtacctgctattcataaagatcgtcatagaattcgccaagaattacatgatgccttaggttatgaaggaacggaacaaccggaagaaatgaatgcttttgtgcgtaaaacattgcgtaaagatttccttgaagctgatattggtatttccggttgtaattttgctgttgctgaaacaggctcggtatgtttggttactaatgaaggaaatctgcgtttagctacaacagtaccgaaaacccatattgcagtgatgggtatggagcgtttagcaccaactttccaagaagtagatgtattaatcaccatgcttgctcgtagtgcggtaggtgcaaaattaacggcttataatacatggttgacaggtcctcgtcttgaaggcgaaaccgatggtccagaagattttcatttggttattgtggacaatggtcgttcatctattttggaaagtgaatttaaggaagtattacgttgtattcgttgtggtgcttgcttaaacacttgtcctgcatatcgtcaaattgggggacatggttatggttctatttatccgggtccaattggatcggtaatatctcctttattgggaggttatgaagaatttaaagaattaccttatgcttgttcgctttgtactgcctgtaactcagtttgtccggttaaaattccattggcacaactcatctcaaaacatcgtgaacacattgcacaagctggtatgacaccaatgttagaacggttgtctatttttggctttactttagcaaactcaaatccgacgttatggaaaataggtgtaaaaattggtgctaaagtggcggctaaagtgattaaaaacggtaaagcaccaattgaggttggagcgttggcagagtggactaaagctcgtgatttaccaacaccagatggcgagagtttccgtcaatggttccaaaatagaggtaaaaattaatggatttacaaaatcgtgataactttttaaataaattggctaccaaaatgggcagacctcgtcaattcattcctgagcctatgcctgagttggtcaataattatccgacaacgcgtttaactgagttgagcaaaaccgacttagttgatgagtttgtgcgttttgctaaagtgatgatggcggatgttattgaaacaagtgaagctgaactaaaccgcactttactggaagtttgcgagaaatatggtggcggtagcgttattttaaataatgacaaaagattagctgatttgggtattttgcaatctgtccaagaaaaatacgatagttatatttgggatttaaatcaaacggaagaaaattttgcccaagcagaaaaagctaatattggtattgtgtatggtgagtatgggttggcagaatccggtggcattgttttattttcggataaagattttggccgttcagtgagtttattaccggaaaaatccattgtggttttacgtaaaagcaccgttttaccacgagttgcacaattggccaagattttacatgaaaaggcacaacgaggagaaaggatgccttcttgtataaatattatttcgggaccgagtgctacagcagatattgagttaattaaagtcgttggtgtacatggaccggtacataaaatttatattgtcattgatgacttataattgataattaaatcgttaaaaaaatgaccgcacttcaacataagtgcggtcatttcttatttgatttataggttatggcaacacattacttttaagccattgttcaaattcattattgttcataaaacctgttatacgagcttgttctatttcctttcctgattgatcaaagaaaatgatagtcggcaatcctaaaacagtcagttgcttcatgagttcagtattgtctggactgtttttggtcatatttacttgtaacagtaagatatgctcaaataaaggctgtacatttgaagcactgaatgtatatttttcaaactctttgcaggcaatacaccaatcagcataaagatccaacatggcaaccgattttggattattagcaagaacttgttgcaattctgcataattttgaatgagttggaattgagaatgagagggttgttgttgaactgcgttttgttcgtgattccaatttgaattgagcaaaaaaagtgcggtaaaaacaaaggcgataatccaacctaaccagttttttcttaattgaataaaaaaccagacaatgaaagcaaacaaccagcttgcccataaataatcactatattcaggtaaaacacgagaaagtaggaaaataggtaacagtaacatgacgaaaccgaaagcggctttgaccttttccatccaaacacctgactttggtagaattttgttgccaaacaaagtaattaacatcagaggaatgcccatgcctagggccaataaatagagtgtaaatgcacccgttgtgagatcaccggtttgagctacataaagcaatgctcctgataatggtgcggaagtacagggagaggcaacaagacctgcaatcattcccatcacaaaaacaccgccaaaagcaccgctcttttgttgttggctgagtaaggtgagtttagtttgtagcgagcttggcagttgtagagtaaagactccaaacatggataatgctaatagaataaaaataacggatagactgaccagtacgtaaggactttgcagtgctatttgaaatggtaatccgattgccgctacaattaatcccaatgatgtataggtgagtgccataccttgtacataagcaaagcttaaccccaatgctcgtaaactattcggtctttgatttgcaccgataataatcgctgacaataagggaagcataggtaaaacgcaaggagtaaatgcaagccctaagcctaacaagaaaaaacctaatggtgcgtatttgttgtttaataagtttgcagcaagttgattttgttcagggtgttgcatggcagtttttcccgcaacacttaacagatctttgttaatagagatttcttgagtttcaggtggataacaaagtcctttggtacaaccttgataggtaatgagtgctttattaatagaactatccgttggaatattgatggatagatctaattgatggcgataaatctcagtttctccaaaaaattcatcttgatgtagctcagcggtagggaaatgaagattctcaatagaaacacgttgatttttgttatcatcattcactaattcaatactgatttcttttttatacagataatagttttcagcgatagcccaatgaagatcaagtttttttccttcttgttgactactgaattgaaatgcttcatggctttttaaaaattgtgtttttttaccgaacatgtttccttgtgcttgagatgcaaaaaaaagtgcggtgaaaaaaatataaaaaatagttaaaatttttttcattcaaatgatccttttctaaatactttaatcgttcaatctatgcagggcgacataatatccgtggcatcagattaaaacaagcgttttatgatctacgtcatgaaatctagctgtatggaaaaaattatctcttttcacttgttacgataatgttgcaattatacaataagccccgaactgaattggattatattctaggaataaagtatgaacataccgcaaattttgattgttgaagatgaagtgattactagaaatatgttaaaaagtatctttgaggctgaaggttataatacgctggaggcggctgatggtaatcaaatgcatcgtatacttgctacatgtgaaattaacttagttattatggatattaatttaccggggaaaaatggtttaatgttggcacgtgaattgcgtgaaaatacaaatacagcattaatgtttttaaccggtcgagataatgaagtagataagattttaggtttggaaatcggtgcggatgattatattactaaaccgtttaatccccgagaattgactattcgtgcaagaaatcttttacagcgtactatgcaagaaatacctaaatctggcaccagtcaggtagaacagtatagattcaatggttggacattagatttaaattcacgttccttaattaatcctgacggagaagaatataaattacctcgtagcgaatttcgagcaatgttgcatttttgtgaaaacccaaggaaaattcaaactcgtgaagagctattgagaaaaatgacgggaagggaattaaaaccacaagatcgtacagtagatgtaacaattcatcgtattcgaaaacattttgaagatcatgcagatactccggaaattattactactgttcatggtgaaggttatcgtttctgtggtgaattagaagaaaactaattaatttgaacagggtaaaaagtgtcatccttttggtattttttgtattggtttgcacattgccctttttctaaaaatgaattgaaaataaatctcactactttcaatactttttctactctaatattttgataagaaaagcatttttaagtaatggaaatctcttaaaaataataagtcaaagagttttattttttgtttctcgtaaggcttgtaaaatatttttcattgcgagatctaatggagcaactaggcgtagcctttcccctgttttgggatgttcaaaacaaatagcaaaagcatgcaagaataaacggtttaagccaagtgcggtcatttgttgattaaaatttttatcaccatatttatcatcaagtgcgataggatgaccagcgtattgggtatgtacacgaatttgatgagttcttcctgtaataggagatgccttaactaaagtagcattattataacgttcttcaacgctaaactttgtttctgaaggcttaccttgttcacttacttttacaattcgttcgccgctcgtaagttcacttttcaacaatggtgcttgtatcatcttacaatgagattgccaatgaccacgaactaatgccagatattctttttgtatggttttttcacgtagttgctcatgtaggctacgtaaagcagatcgtttctttgcaataagcaatatacctgaagtatctctgtccaagcggtgtactaattctaaaaaacgtgcttcagggcgtaatgtacgtaatgcttctattgctccaaaatttaatccgctaccgccatgtactgcaaggcctgaaggcttgtttaacactaataaataattgtcttcaaagataatttgttgttccaactgtgcgactttattcaatttttttgaaataggggtatgttctttttccgcaatacgaaccggtggaattctaacaatatcaccactttgtagtttatactcaggtttaattctgcctttgttgacccttacttcacctttacgcaaaattcgataaatcaaacttttgggtacgcttttcaattttgccaacaaaaaattatcaatacgctgtccactttcatcttcattgattgttagtatttttacactttggtttatgattttttcattaatatgtgtcatttttaaattttttcagcttatcaaattgttatgtatcatagcataaaaataggaattaccttgctaaaatttatttatcagtagataatagagcctatttttgggtaggtaaaatactcaaaactaaataagtcatcattgatcattttttaatgctgcgaatggcgtaagacattaatatatgaagtgatttcttggtagattaaagtaaacgacagcttgcaaaattaaacatttcaataattttgtttgtattaagaaagctattttaacacccgtcttaataacgcattcaatgcatccggcaactgacagtcgagagacaggcattttgtgacagataataggtcgattgcgaagcaaagagcggttattttaatgctaattttgataataaaatttagagaaaatttaaacaatgaaaagaatgttgattaatgcaactcaaaaagaggagttgcgtgttgctttagttgatgggcaacgtttatttgatttggatattgaaaatcctggacatgaacaaaaaaaagcaaatatttacaaaggtcgtattactcgtgttgaaccgagtttggaagctgcatttgttgattatggtgtagaaagacatggttttttacctttaaaagaaattgcacgggagtattttccggatgattacgtttatcaaggtcgtccgaatattcgagatattttatctgaggggcaagaagttattgttcaggtcaataaagaagaacgcggtaacaaaggagctgccttaacaacctttgtgtctttggctggaagttatttagtcattatgcctaataatcctcgtgcaggtggaatttcacgccgtattgaaggggatgaacgtttagaattaaaagaggcattaagctctttggatgtgcctgaaggcgttggcttaattgttcgtactgccggtgtcggtaaatcacctgaagaattacagtgggatttaaaagtcttgttacatcactgggaagcgattaaacaagcctctcaaagtcgtcctgctccctttttaattcatcaagaaagtgatgtgattgttcgtgctattcgtgattatttacgccgtgatattggcgaaatattaattgatagcccgaaagtgtatgagaaagcgaaagcacatattaaattagtgcgtcccgattttattaaccgagttaaactttatcaaggtgaagttcctctgtttagccattatcaaattgaatcacaaattgaatctgcgttccggcgggaagtaagattgccttccggcggttccattgttattgatgctacagaggcattaaccgcaattgatattaactcggctcgttctacacgggggggggatattgaggaaacggctttaaatacaaatttagaagcagcggatgagattgctcgtcaattacgtttacgtgatttaggcgggttaattgttattgattttattgatatgacaccggtacgtcatcaacgtgaagttgaaaatcgtatgcgagaagctgttcgtcaggatcgtgctagaattcaaattagccgtatttcacgttttggcttactggaaatgtcacgtcagcgtttaagtccttcattgggtgaatcaagtcatcatgtttgccctcgttgtcagggaacgggaaaaatacgtgataatgaatctttatcattgtctattttacgtttacttgaggaagaggcattaaaagaaaataccaaacaagttcatactattgttcctgttcaaattgcttcttatttattgaatgaaaaacggaaagcgatccatagtattgagaaacgtcataatgttgatattgtggtagctccgaatgaagccatggaaaccccgcactttagcgtttttcgtgttcgtgaaggtgaggaaataaatgagttaagttataacttagctaagttgcatgaaatgaatgatgagacttatgttgttgaggacgcttttatttctcgtcaccttgaaaattcagcagcaacagtggaaagtgcagtcgagaatgcggcggtttcattagctattgaaactccagcaccaatgccacaagaaagaaaacaagagagagaatccttattgagacgtattattgaggggattaaaaacttgtttgctgataattcaagtaaaaataaaaaaaacaaaaatactcgtcagaataaaaatgctcgtcataatcgtcgtaaccaagatcgtcgttctagccgtcgtattcgtcaagagcatgagattaaatctgatgaaaataataaattagatacacagcattctcattatactgaacgttattctaagcatgctaagaaaggcgttgatgatccgcaaattcagacaaagaaagcgggtgagttggaaattcacacaaaagatgaggagactattgaaacaattcagcctcgtcgccaacgtcgtgatttgcgtaagaaagtcagagttgaggaaaatttagttgatacgacaaatttgggagcaactgaagaacacgttgaaaatgaaaaaacaacagagcctgttacaagtttagaacaagcggttttacagacagaaaatgagaaaactcatgaacgtcaagataataactatcgtcatcgacgcttacctcgtcatttaagagtgaataatcaaagacgtcgtcgtaatgtagagttgaaatctgcgatgcctctatttgctgcggtagcatctccggagttagcgagtgggaaagtttgggttgatgttaatgtagttaattcaaaaaataacaattttttatctgtagatgaattactaaaacagcaatatcaacaagaggaaattgaagttgttattcctgctagtgaaatcttgatggatactcaatctgatgatattaagcctttaagtaactttgttagccaaccagcaaatgaagcagttgaaaagaaagttcaagaaaccttgcaacgtttaactcaagaggtggttgacgaatcatcaacaatcgaacgcacagaggtagataccaatatttctgtacctgagtttgtacgtgaatatcagtttaacggacgattggggacaatttctgcggttatgcatacgaaagcagaaatgacacttgccaagtcaagtgatgagccaatgcagcctttctcaatcgttgaatggcaagattctcgttattatttctatggtagaggagcggcaggacatcattgtgcaatcagccatgtttattctgaacctgctaatactaaaatagaataaatattttacatgaatgaaaattccacgcttgaatagaacatgagaaaatcatggacaatacaggcgtggatttttgtttttataaagtcataaaataggtataacaaagaaaaatctatagaataactttcttggttctgatggaaaatatcgtaaaacttctttttgttctttcgcaagtgagtatcggctcaaaacactctgtcataggtacattgtagtagagaagagtttgccatagtttagaaattttgaaaatgtttcaacacattgcaggataggggttaaatggtcccccctaccggacttgaaccagtgaccaagcgattatgagtcgcctgctctaaccaactgagctaaagggggacaggtcgtggattatattgaataaaaataataaagtctataaaaaggagattaaaagcttaaaattcattcaatctcttgatttcaactattaatgtgcctcatcccaattatcacccacaccaatatccacaattaatgggactgataaatgtgccgcattttccattaaagacttaattaatgcagaatattcatctaccttattttctttcacttcaaataccaattcatcatgaacctgcatgatcatttgaatatcattttttttgatttcgttatgaatagcaatcatagctaatttaataatatctgccgcagtaccctgcattggtgcatttatcgccactcgttcagctcctttacggcgtattgcattagatgaattgatttcaggcaaatatagacggcgtccaaataatgtttctacatagccctgctcttttgctttttctcgaatatcaaccataaaagtttgcactcccggataacgttggaaatatagatccatatatttttgagcatttgcccgtgaaataccaagttgattagataaaccaaaagaactcattccataaatcaagccaaagttaattgcttttgcacttcgacgttgttcacttgttacttcatttaatggaataccgaaaatctcagctgccgtagaacgatgaatatcttttccctcattaaatgccataatcaaaccattatcttgagataaatgtgccataattcgtaattcaatttgtgaatagtctgcggcaataattttataccccttacgtgcaataaaggcttggcgaatacaacgaccttcttcatttttaatcggaatattttgtaaattgggatcgctggaagataaacgtcccgttgctgttactgcttgatgataagatgtatgcactcgtccggtttttttgttcaccattgaaggtaatttatcagtgtaagtagattttaattttgctaatccacgatgttccatcaataatttaggcacaatatgtccctgttgagctagcgtttccaatacatcttcatttgttgaaggtgcaccttttggggtttttgcaatgataggtaaggctaatttagtaaagagaatttcttgtagttgtttggttgaagctaaattaaattctgctcccgcttcttgataaacttgttgctcaagtgcggtcaatcttctcgcaattttttcagattgctttaacaatgcctgactatcaattagtacaccattgcgttccatcgttgataatacttttaccaaaggcaactcaatatcattaaataccttcactaaacttggcgattgttgtaattcttgccagaggacttgatgtaatttcattgtaatatccgcatcttcagcagcatattctgtcgcttgagcaatggcaattttatcaaacgttacttgtttttttcctttaccggcaatactttcaaattcaataacttgatgtcctaaatatcgttccgataaggcacccatattatgtcgtcctgtgctgtcaagcacataggattgtagcatcgtatcaaaacaaacaccgtttaattgaatatgatgattggcaaaaatagttaaatcatatttaatattttgtccaattttttgaatagacggattttctagcaacggctttaattgtgccagacacgtctctttatttaattgattttttacaagctcaaattgttcagcattttgttctgattcagtgaataaatctgtttgtgtcatttcttttacagcttgtttatgagccagaggaatatagcaagcctcgccgttggtcagtgcaaaggaaataccgacaagattagctcgcataggatctaaagcatcggtttccgtatcaacagcaataagatctgcctgttgaagtttttccagccaactatttaatttctcttgagtatcaatagtttcatatgaagtgcggtcgattttaatcgtttttttgaccgcacttttcgactcagaggcactatttgtttgagttttatcaagtttaatttcttgctgagttgctttggtaagtgagctttcaccgcttatcacttcgtttagccaacgtttaaattcataacgagcaaagtattcaatcaattgatcttggttattttgccccaacacgagttgatccggtgtaatatctaactcaacgttggtttttattgttgctaaaaggtaagataaatccgcatctgccttggcggaggatagtttctccccgagtttttttgctcctctaactgataatccagccactttttctaaatttgcataaatttccgccatactcccaatgccttgcaacaatcccaatgctgttttttcaccgacaccgctaactcccggaatattatcggagctgtcgcccattagtgctaaataatcaacaattaattcaggcggaataccatatttgtctattacaccatctctatccagtaaactgttattcatggtattgatcaacataatattatcatcaaccaattgtgccatatctttgtcgccggtgctaattagaacgttttttccctgctgagaggcctgaaccgctaatgtaccgattacatcatcagcctcgacaccttcaacagacaacagcggaattcctagtgctttgataatattgtgtaatggctgaatttgttgacgtaaatcatctggcatagggggacgatgggatttatattgttcaaatatttcatcacggaacgtttttccctttgcatcaaatacaaccgctatatgggtcggttgaacctgagcaattaaactttttagcatattcaatacgccatacattgcacctgtcggttcgccaagagaatttgttaatggaggaaaagcatagaatgcacgatataaataagaagaaccatctacaagaacaagcggattttcagcaattttagccataatagaataatctcaaataacacaaagagcggttattatagagcaaatttttgagggaggcgaatttgaaaccggaataaacaagactgaaaagaatatattttaagcaatgcaaaataaatccttagacttacgcaacttaaagcaatacaatttcccatcaattttgtcgatgtttttaactgcacttttaaaccaaaagatcttatgaaactcaatgctcaacaacaacaagccgtagaatacacacaaggtccttgcttagttttagccggtgccggctccggtaaaactcgggttattattaataaaattgcttatttaattgaacagtgtggctacttaccaaaacaaattgctgctgtcacatttactaacaaagcggctagagaaatgaaagatcgtgttgcacattcaattggtaaagaaaaaacaagaggtctgcttgtttcaacttttcatactttaggttttgacattattaaacaagaatacaaacatctcggttttaaagccaatatgaccttatttgatgaatatgatcaaatggcattattaaaagagattacggcagatctattaaaagaagataaggagctattgcaagagacagtttcggcgatctctcgttggaaaaatgatcttattcttcctcaacaagcgttcactcaagtaagagacagtaagcaacaaacttttgccaagtgttatgagcgttacaataatcaaattcgtgcctacaatgtattagattttgacgatttaattatgttgcccactttattatttctccaaaatcaagaagtgcggtctaaatggcaagaaaaaattcgttatttattagttgatgaatatcaagatactaatacaagtcaatatgaattggtgaagttattagtcggtcaacatactcactttactgtagttggtgatgatgatcagtctatttactcatggcgaggtgcacaaccgcaaaatatggctcggttaaaaaatgattttccacaattacaagttattaaactggaacaaaattatcgttctaaccagcgtattttgcattgtgctaacatcttaattgcaaataatgatcatgtatttgaaaaacgtttattttctactttagagcaaggtgaaaaactacaagttttggaggcaaaaaatgaggagcatgaagcggagctggtcgttggagaattaatcacccatcgttttatgtataaaaccaattatcgtgattatgcaatattgtatagaggaaatcatcaatcaagactattcgagaaagtcttaatgcaaaatcgaattccctataaaatctcagggggaacttcttttttctctcgagcagagattaaagatatgatggcttatttacgtgtactgataaatcaagatgatgatgcggctttattacgtattattaatacacccaaacgagaaataggctccgttactttggcaaaagttggaaaacttgctcaagaaaaacatattagcctttttgacgctatttttgattttgacttaattcaccaactcaatcccaaatcctataatgccttacaaggctttgcatattggattgtcgaactcaatgatgaaattcaacgctcagagcctgagcaagcaatcaaacgaatgttggcacagttacattatgaagaatatttatatgaacatgccaacaaccctaaaattgcagaaatgcaaagcaaaaatgtagccacgttatttgaatgggttgcagttatgctaaaaggagatgagttcaatgaatctatgtctcttagtcaggttgtcagccatctgacgttacgagatatgttggaacgcaatgaaactgatgaagaaagtaatcaagtgcaattgatgacattacatgcatcgaaaggtttggagtttccacacgtttttttaatcggaatggaagaaaatattctgccacatcaaaccagtattgatgaggataatgttgaagaagaacggcgtttagcttatgtaggtattactagagcacaaaaatctctcacattttctttatgcaaagagcggaaacaatttggtgagattttcaagcctgagcccagtcggtttttatctgagttaccccaagatgatcttcaatgggagagaaatgaaacacatgcaacagaacaagaaaaaaaagaaatgaaaaatgccggatttgccagtttaagggcgatattaaatcaataatgctacctattataaattttatacctactttgtagataaatcagacaaccaaataaattttataaaaaatcgtttgacttatttttagaaaaacgtattataccgcccacaaaccgattgtggtgagatggccgagccggctgaaggcgctcccctgctaagggagtatggggtcaaaaactccatcgagggttcgaatccctctctcaccgccatttactcagtgcatccgtagctcagctggatagagtactcggctacgaaccgagcggtcagaggttcgaatcctctcggatgtgccatgttgatttttgattttattgaactctacaataaaacatacacaataatatattcggttaaaaatcaaactaatacgcacccgtagctcagctggatagagtactcggctacgaaccgagcggtcagaggttcgaatcctctcgggtgcgccatcgacaaaaacccctgataaataaccatatatagccccttgcgatctagcgtgataattgcttgaaaatcaagtattttccgcatattcaaaaacaaagtattgtatttatatacagtataaattatgatctaaaagaaccgattacagaatttaactgttaccaaaaactgatccaaaaacaaaaaaagtgtaccaaacaaagaaaaaaggggggatgaaatggcaacttaccaaaaacggggagacaaatggcgagcaatagtccgcaaaaagaacgttctaaaaacaaaaacattccgcacaaaagcacaagcgttcgcatgggcaaacaaaatagaagcggaaataatggaaaatttatatcaagaagtggctaacatccctctagaaaaagtgatagacagatacctacacgaagttacaccacaaaaacgaggagcaaaaaaagaacgacaatttctctaccgtttccaagcattacccatcagcaaaatatcactgagacacctaaacgaagacgacttcaaacaatggcgagatgaacgactaaaaaaagtctcctcagcaacagtattaagagaatgggcggtcatcggacacatactaaacgtcgcaatcacagaatggaaactactcaaaaccaacccactaaaaggggtcaaaaaaccgaaagcccccaaaccaagaacgagacgctacagccaacaagaaatagatgccttagtctatacatccggtttttcttggaacgaaccgccaacgacagcgactgcaagagtaggagcagcgatattattcgccatagaaacagcaatgagggtaggagaaatagtcaacctaacatgggaacacgttcattttaacgacaaaatagcccatctcccacaaacaaaaaacggctggtcaagagacgtccccttatcaacaaccgcaataaaaatattaaaattattggaacaaatcgcagagggagaaagcgtattccaattatcaacctcaagactggatgcgttattcagaaagttaaaaaatagaatgctactagaagatttacattttcacgacacaagacgagaagcgttaacaagactggcggaaaaagtcgacgtaatgacattagcgaaaatatccggacatagagatctaagtatcttacaaaacacctactacgcaccggatatgaaaaaagttgccttattactggattaacgttttgctcgttgacgtttacgagcaaacgcaatcacatcgccagcaatccaacgattagcagaacgtccacccgtgcgacattgcaacttcaccgcatccggaaaatccggatcggacataatagaacgtttcgtatgctcatagctcatcttaaaataagtagccacatcttgagccgtccaaatagcttgattagtttgcgtatagtttgccaccttcaacaactcacgcacagcttgcaactcccttaaaatatcctcattggttatcgcttctttcatcgcttccataaaaatttcctctaaaattccttaatttctctaaacaactcggctcattatgctcattcccataaaacgaacgtaaaggcacagagtggtctgaaataatcacctcatcattgataagtttcatcgatgtcatcgcattcaatctaaccgatctacctttcaacaaatgattaattgcatgctcattcaacggtttcccaattggtcgtatcgcttcttttattttttgaacaatttcctcccttcttactaaattttcaaggttacagttactgacacaagtccaaggttgcactacgtgcaacttagtgtcgctccgctccatttctttattacgtctattcggatcacctttcttaatgacccactttttaagacgtgttttaataaaatcacctaaactaaatttattgctcaccccatttatttttttatgtgtctcttggtattgattaacctcgctttcctcataatgcaaacacaacggcacatccttacgcaacgccaacggacccccaagacgtttcataaaagcagcataatcgccaatatctgcacaaattcttgcctcttcaaccaattcatcatcagcttgaccggcaacaagacggcgtaattcacgccacacaccgacatatttatccccataaaattgaaactgacgaataccccaaaggctcgcccatgctctcgcttttttagcattatcttttaaactcatatcggcatcttcatcagaccgctcaccatctaaagcaaaaccattaatattttttgaaatatacttagcaatataacccgttgccgagcccttagttttatcgcaatcttcaattttacagcgatgttttttagcccccatttcatcaccgtcaagctccaacgctttttcacgaaacaatctcaccacctcttcacgatgcgtctcatgaacataaaccaacaaatgccaatggggcgttgcgtcatgatgaggttcagcgacacgcataccataaaaagcaatattacgttttttcaataacgccctgaattgcccccaaatcttattcaaatagtcctgcgtttgcttaggattagcccctttccatttcttattttgcgtaccgtcattatggattgcatggaatgatgaaggggcggtcagcgttaaaaacaacgcatgatgatcggactcctccgcccactcctccaacccacgtaaacgggtcatcaactcaatccgacgctgagccggattcgcagaagatttcaaatacatatcaaacagctcagcttgctcactcggatcgtcgatattctcaataatcatctgtttcaaaaaatcatagtttttcttaatctcatgcaaatactcagaaaaaccggctcttgaaatataattgcttctgcgtttgcaaacctcgccacaggcaatcgcaacatgctcaaccatctttttctgcaccttccgcatacgcttaaaccaatatttctcacaaataatcttatgaaaaaccgtatcaatataatccaatctaaccggctttcctttcttaaacttatcccaatgggaaacaggaaaaccaatattttcacaagcctcaccgcataactgataaatcttccgcatatgctcattaaactcatcatcgcttaaatccgaccgccctttttccaccaaatccaacatataaccacgctgaacattagcaaacagcgtagccaatttataagcaatctcctccagcttcttctcgctcaacaaataaaaaggcatttttgcacgttgacattcttgacggctataatgctcaaaattcttgcgtaacttcaaaatctcatgttgctcacgcaacaaccggctttcatattcctccggctcgccagttaccggcaataaatccccattgtgcggttgttttttttccaacacatcaaaggacaaatccgctaaccatttcggatcacgttcatcaaacgccaacaaccacgccatattgcaacgatactgatcgaacacaaggcgtaaacgagtacccaaggtttcacgcaaccaagtattagcatgtctacgttgtttattcccgaaagcaaacgaaatcgacccatcatcttcaacagaccgatattcatttaaatacaaacgccgaaaatgctcacgttgtcgttcacgtggcaatttcgccaataatttctcaacaaacacatagctttcgggaacagtattaaaaagctccatctgagcttgtgtccctgttttttcctctttatgaggaacacgaggggaaacctggaaaaaaggcaccgcagtttccttttgctcgtttttaaataccgtcacgaatgccataaaagcctactcaacaacttaaaacgatggcggaatatgagccttcaactctcgcacttccgcataaatcgcctgcaacacattgagaatatcaaacaacgtattcacatcctcattgcgtaactcacaacgaattaacgcctcaatgacatcctcaaattttctaaaacacatcacctgccgagccgagctacctttctgatccaacataaaaaccgctttttcgcccggctcaacctttaaaatctcataaacaccctgacgaattcgtaacaaataacaatcagaaagctcaaaaatataatccgtcatacagaccccttcacaataaaatcacgctttttcacccccgcatgatagaacggcaaaagtgcattcaacgtactaaaaatggcatttgaaatcttcttctgcccggattcattaaaatgtatcaatttagaatattgataattcaacggatcgaccaaatccgacgtctctaatttcgccttatcaaacaacgcatatttctgctccatcggcaaggcatcaaaaatacgctcggcagcattaggcgactgatttaaaatacgccgcaaagaagcaacccccgccttagaaaccgcctcatgatcgggtaaccgctgaacaataatgctctccacatcaaaatgacccataactccccctcaagcctagcgagccaaaaaatcccaaaacgacgtcaaaaaacggcgaacgcaacccagtttcggcggttgttttttctcttctggcaaagtaacacgttccaattcgctcaaacgttgcaaaatttcctcattagtgatttgataactttgatgaagctcaatatttaccctattcatttttttttgtatttcaaatttacgttcaatatttgccaaacgcttttccatcttaaaaagattgatacgttttttattcattgcagtacatttttgatgaaatttttgtttaatcatgttgtgtttcctcatatgtgttgttttccatttgtgcgaatgtgattgcctactgtaggggcggattacatccgcccttttttaggttgcaaaaacccacgccattaaaaaacagcgattttttatctaaaaagaaagaaataatagattacgtgtcttcgtcgattggacttgcctcaaacaaatccttcgtatttgtatcactttgtaacaacggtttattaatccgctttacctccggacgctcatgataagtaggcgtttgcaccgtcacaatttcgctataaatatgatgtttagtagaacaactattacaaacccaaattgcctcaatcaccaacataccgacggattcagaatgacgaacccgcatactatgactaccgcaattggcacacttatgattcatatttgccatctttacgctcccagcattgccgaataacctcccaatccacatcaggacgtaaatcctcgggcgttacctcgccattagtcgccttgataagggacgggatatatttcacgtccatttttccgccttttagccaaatagaaattgaaggctgactaacactacataatttcgctagtttcgtttgagtaccaaccaaattaattgttttttttatatttttatccatttaattattccttttttttattaaggtataaaaataattattttaattatagattattacttttattatattcagtcaataacaaaatgaaagttgttttttataatttaagttataaaattaaatacaggagatttttatgaatacattagcttcccgtttaaattatttaatgaataagattggagtttcccagtctgaattagctagatatatagggataacacagccatcagtgcataaaatactaaacggtgaaacccgcaaccctaaaaatatagttgaaatagcgaccgcacttggcgttgatgtgcattggttaaagacaggcgaaggagaacccaatattacgcctcattcttctatattggtgagcaatgaacccgacgaaaagcatactcaccgcataaaccgatatgattttcaactatccgccggagacggaatcattaactcggattacccggagaccatttcgagcatttggctcacccctgaaggtatgatgcaaataatcggacgttatagtgaaaaagggatctgtatttttaaagtccccaccgacagcatggaacccaccatctcatcaaaagacctcgtttttattgataccaatattacctattttgccggcgacggaatttatgcctttcgacttaacggcaaagactacataaaacgcctccaacaactccccaccggcataatccgagccttaagcgacaacaaactttacgaccctttcgacattacagaagaattattcgacaccgcagaaatcgtcggaaaatttatccgagtcgtccccctcaacccaaaggatttgtaggggatatttttagctcggaaaaaggaacgttaaatatgattaaacaaaaaacaaacaatttcttcttcaacacaaaggggataaaattggcgatgtgtgatacagataaattcacacgaagacaacgacctaatccggctgacaaaggaaaacaaccctatgaagacgatgacattaattcaacgcaaacaatcccttgagtttgatattcaacgttctattcgttataacagtaatggttggtaatggttggtaaatttttacaatccctaactcagggctttatttttcctcgccaccattaatatccaactccaattctaacgaggttgtaaatccgcttgtggtgagattatgggtaactttactgattatccaattgctactgtcgatttggtctttaaaccctcgcacttttacacgcaattcaggcataagccacgcattcccatcagctaaattaatcgacaaactcgcaatcccccttcgcattttgtcaaaagcagctttagcagcattgatagcataagcttctgttttataggtatgtctcaaggttttcatcttattactatcggtttccaccggttgagtttgaacaagcgtaacttttttcttggtttttgatgtttccgtgcttgttccgccttcctctgtggggtgtgtcggttttgccaagcgttctattttggtattttcatcaatcaccacaacgccctttttgcctgtgtccatattatgccaataagcacgaaccgctttataattgtcgctttctgtcaacgaaaaagaaaaattgtcgcccatctgccttgtaatctcaatggtcggcaaggctttaccgctcacagtcaaccccattcccacaggcataaataataatttaccgtttttcaccgtcgcaatggcatcgtaattttccgctaaacgacttaacaaattaatatcgctttcattggtctgatctaaatgcggaatcactttttctttaaacgcctcggcacaagccccctcaagttgattttcttttgcaatctgattaatcaaattttcaaatgaaatattatcaaaggaacgttcttttttatcgctaagtgagcctctcaaatccgcacttcttgcacgaagagtaagactatccggacttccgctatattgcagttcatcaacaataaatttacctttcggaattaattgctccccttgccaaccaatggctacttcaagcattgcaccacggcgaggaaacgccaatttcccatcatgatcacttagctgaatatcaatttcgtccgcctcaaatcccctgttatcagcaatcgtcatcgacattaagcgatggctaattagcgtagtaatgtcttttttgttttcatcttgcgttatcaccctcaagcgataatgaggaatccgatgatgatttgctacagtgcggtctaaaaattcagaatagctcatagttcaattaaactctttaacgtatcgccaatatcttttaacaaactttcgtttgtccgttttaacttcattgaaaaatcaatgcgacgtgaagcaccgtccgcaaaaaaataggatttcccgacgctaatttcctcaatgacaaaccagcctaaaacaagaaaagtactcccatcaattaacggcaaaggctccccctgttccgctaaggtttcaagggcagtaatactgagagtagatcccgtaatttcaggcattaacacgccattaatggttaatgtttcgctatcctttcctgtaaattgtgttttgggtaattcccctatcactgaatttgtcggatgtcgccacgtaatagttctttgcgtctcctgataaggtatcgttgaccgcataaaaacaaaaaaaccatacgccatcattgcattagattgaatcattgcttttccttccaaagggctaataaaaagcggtgaaattcgtcaaatctcaccgcactttttacgtgtctacttggcttctttctcttgctttttcacgccacaacatcaattccgctaaatccatttcatcaaatacagccggcgaccaatgaaaaatagtggcaatatccgcaatagcgtcttctacgcaatgaggaataactaagcctgttgtgtcgccgttgtattctccgtcgtatcgttcgtttccgttttgacgaaaaaaccgattacctccgaacaaagggcggtaaaatcaatcggatcaaggtttaaaatttccattttccctaaagacggttgcgttacacgtggcaacagttggcaataagcgtcaacgtccatttgcattacatcaaacatcttcaagcctttaagggcattaacatttggcttaattaaacgaatttcattgatttccgtttcgccacgttttaacggctgaatcagtgtaacagttttatttttcatctttttttccttacaattcctatacgattataaaccgatggctcggcgatgttcttttaagcgatctacaccattgacaacaaaaacatgattaattaaatcaatttcaatcagcgttttaccgttgacgatttctttgtaatacgtgagtgaagccttaaaggtttcttccgtatcatcgcccactttcgcattacccggatcaatttccgtataacgcccacgcataactaattcaacagcggttacttcgcccgtgtcgtcacgttgataagcctgcgacaaacgcaacagtacgccgccaatttctgccgaaccgaataaagcacgcatattctccatatgcccaccgaattttaattcagcctctaatttttctaagcctaaattaatatcgacttcgcctaacatatcgcctgcacgataactttccgctttaatggcgagtttggggcgagtaacctcgttgacttgtcctaaataactttcgccgtcttggtgtaaattcattaattttaatttattgggtaaagacatagttcatctcctaagcagcagcgactttagatgcaaattcagttaaataacggtcggtaatacgttgacggaaatttaaattttctaacggcggtaccggtgtatagtcatagtcaatatacaaacgccccgcttttaacgtctctttgctattaatctcagcgtcataccaacagctggcgtcaacaagatagcctaatgcgacaagttccctaaatttcgcattcacaccctctataatgtctttcactaatgtcggggtcatcggcttatcaattgcccaggcgtgagcctccgcaatcgtatcacgcaaaatttgagcggtacgtgtatagttttcaaactggaataacggatcggcagaacaagtacgagacccccacaaacgataaccattaaaattaatcggtacagtgacgttattttcattcaggtaattggcgtctgtactggtatcttgaatatcaaaggtaatatcacgactcaccccgctcactccctcgacaaccacattagaaatcgttttatgccagcccatagttttatctaaatacgcacgcaatcctaacgcacgagcaaccgcactttcattttcaaccttcttactattaacatcaaaagctaaaaaatcaccatgaataaccataacttcacgctgtccaaatcctttttgatattgaaccgcttgctctttggtttcgcaaccatgagcggatatatacgcaaacgcatttaactttttagcgacgccggctaattctgtggcaacggctttattatccaagtaaggcacacccaaaatacgaggttttacgccgattttactttgggcaactaacaaggctttcatacccgtatactgtcctttttctgttaccgtaccgataatatttgccgtggtttgtgcattatcagtttcagtgtcgctgacgctttcgtcttggacatcgctctcactatcgccaccgcctcttctcgtggctttggttttgctttttttgccttcttctacacgcactacaacagtcaacgtattgacctgatcactaattgcttcaagggtttttgccaacgtacccgtcttgcccgctttagcaatcgcagtcaacggattcgttaataaaacaggggtattaagtggaaacgcttcactatcagcatcatttgcggtacaaacaacaccgataaccgccgttgccacggtttttattgtgcgagtaccttcgttaatctcaataacacgcacaccatgcaaataatccatattaaaatcctttcggttaagttaagggaaatttcagacatcttaggaaatcttaggaaatctcagctattgtgcaaggtcaaaaaagagcggtctagtggcttgaaatgtgaaaaataaattcacctgcacccgctaagaagtcctatcgcattgacaaccataaagcgtacattataatgtacataaaaataaaatagagaggttcctagatgcttaatacaaatatcacgaattttagaaaaaatattttttcactgttggaacagacgattaaatataacgaaccggtcaatgtgagtacgaaagacggcaatgctgttattatcagtgaagaagattataacgatctgatggaaacactgtatctttcttctattccaacgatgaaagaaaacatcatagagggattacaaacgccacttgatgaatgcctgtcagaaaacgaggtacagtggtaatgtattccatcgtttatacaaaaaaagcagctgatgatatacctaagctcaaattggcaaaattggagaaaaaagcgaaggcattgatagaccttatccgtgaaaatccctatcagacacccccgccttatgagaaactgctaggcgatttacaaggggcttattcacggcgtattaatattaaacaccgccttgtttatgccgttttagaggaaaaacaaacggtaaaaataattagcttgtggacacattatgaattttgagaaatgaagaaaccgcccttgttgagagcggtaactaaaaggaactggattatgtattttaagttgttaatcctagttatcttaatcttaataagcacgccagcttattagattagaaggctaaaagtcctggcagagactgccatctctgctaggcagttcctaaatactacaaccacagctattaaaaatcaacaatttataggaaaacactatggcaatgacaaaacaagaaattcaagcaaaaagcgatgctaagcgtggtgttcggttgcaatcctacaaacttcacgaagatattattgctctactttctgaactgtcggagcaaacaggactttctaaaacccaaattgtcacacaaggaattaaactgtttgccgaaacaaaaaaggtcgcttagtgttaaatccgtttaaaatcagccactatttgagccaactgattaggattaaatcgccagcccttttcgcttctgaatatggcattaaaacaccattccgagcaaaagaatttacttttcttctcacgaaaacctaatactaagccaaacacgccttgccaatcatagttagccccttttgtcttcttaaaataggctttcacttgttcttcagtgagattatcaagcggaattaaatcccatttttctgtcttaagggtcatttctttttttcgcacaccgccatcacgagggcttgaactgtagcaatcgtaggtgatatatggataataatcgccacttaaaaacgccgtttgctcaatggcaatttcacaatggctatattgccccttcgtgatgtgacgaataagcccatctgtaaatcggtcatagaggctaccgcctcgccccttgtacagagctaaatacaccttactcattgctcaactccttcaaatactccccataactggttgtccacccgctggaataatcatattccgccggattgtccgattgctccatagcggttttatgtttcaaggcgttagcatgattacttgttttagcctgcattaacgcctgccaaatttgcattaatttttccttatttatcatcaaaacagcgttatccgcacaagtccacgcaatttccatatcaccgaataaatcataactggctttcaccgataaaatattccgctccgccgtagcgtccgtatcaatccacttgcccaccgcttccacaaataccccgccattgattttttcatctcgcaaggcattgattttctctcgcatttccgcccgcacttgggttaaatgtgcggtttgattttcaggcgaaataacccactgccccttttcaatatgatgaaatggactgggttgcggttcggctaactgcggataaccgttttcatctgtgattatttgtttgccttctgattgacccatcagtaaagagcggtataaatcttcggagatttccaccgcaccttggggaatattgttgtgaatgtggctcatataaaagccgtctttgaagtagattttcatgtgttgtccttggttgttgtttttgctaaaataaacttatatttaacttatattctttattcatgaagtcggttattttccaacccaaagcgttaaagcaattaagaaaaattccaacaggggcgaaaattgcacgaaaatgccaagaattaacgcattttcctttttgttctaatgtaaaagcccttgttaatcatcgttacccctatcgttttagggtcggcgattaccgagttttctttgaaattgccggcgatatgatgaatattatttccattgaagaggtgaaaaaacgagatgaacgcacttactaacattcaatatttacatgatgaaagcggacaccctgcttttgccgtcatgcccatcgctacccttgaatggttaaaacaacaagcaaaactttcctctcctttagatagtggcgtgccttttgctgtagcgacttttgccttagaaaataattgctccgcacttgttgcgtggcgtgagcatttaggattaacgcaaaaagacatggcaagccgtttaaatattactcaatctgcatatagtcaatatgaaaaatcatctcacttgcgtaaagccacaagggaaaaatcgcccttgctttaggaattcatgcgacgcaattggatttttaattgtcattatttgtcctctttccaacgtccgataacaagccattctgacttacccaagtaccagttagtgataattgcttgggtatttgtatccgcggtcataaatatccagttatattgtccttcaccactcgctctatcttcgtatttttctgttatgaaacatcggtaatttttatccacaaaggcaattggaaataccacgtgatttttcacggtataaccttcacttttatgagtgaaaataccagtctgaatcatcgtaccatcaggatatttgcgtacctcaacatcaccgattttttgatagctaaactgagaggcaacggcactgttaaaatcggtaatttggctagctgtgtgcaaatgctctaaatccgatttgccctgcaacgctacagcgattttacttgcgtccatcattccttgattatcgacagttccgaatgccttaatccaaaattgtacatcgtcaaaggtatttttggctttaatgcacaatttgagaacaagagacttaggacgagtttcttcggcacctgaatagaatattgctccgttagtgcggattttataattatccgtagttttattattcccagtagcaattgtgtcattattgtctacatggaactgataattacttgaattatggtttgtgccataatttaagtaatgcgttttaattgcatcctcttgtaccctccccacaaccagctcatttgctgcattacgcaaaaaacggtcttccgctttagggacgttgtctatactggtatatttttcaatcaggtatttatacaactcagggtaagtatcttcttttaccttttccttgatttcatcaaacgcaatccagccatcaggaatattatctgtcgcaaaatacgccgtcataccgacatctgagcgagttaaattgggtaaagtgtttttattgcctaaagtgcggtataaatcggggtaggtgcgttggtcaatagtcgttccatcgcattttaaaaagccagtgggattagtaatagcttttggaaacgctacaatcgcccccaaaggcacaccatcaccgccgatatctttccattccgtccattttgagccgctaaaaaagcgagttttgacttttgtatcattggctttgcgggcgatttgtcgcacggcggtagtttgcccaccgctcaccacttcaacatgccacgctccgttgttgtcgggcaaatgctgactgctcgcaaaataataatgcccgtcggttttgtaattatcaacatcgtccgaacctgttttaacctgaaaatcggtaatgccgtagccagctaatgtagtttcaggggattgtttgctttcagcaagttttcttgcgtcttccgctttgtcgtaggcagttttaaccgcttttgatgtagcgacagtatcggagctattgctatcggttgcgtcggattttttgctgtttggaatatattcctctagcttttttgctaactctttccccgctttagcggttaaggcgagtgtttcgctgtctgaggttgtctcgttggtcagttgcacaatgccttgttggcttgtactcgctttggttatctcgtgagtatgtccgtcttcatcaattttattttgactgttgccattaatggttttgggttgtagctgtcccgttttcgcaaaaataacgtcattatctatttttaattcaaaggcgtctgatgaggataccgccaaaattaagcggataatttggacttttccgctaccgcttgataattgaggtttaaaactttcagggcaattggcataagcaactaatttttcattctcgtctaacagtccaatttctctaatccaaaaaccgccctctgtttcagggatcagtaattcaaagataacttgctgatgatttcttggatcgacagagatttgatttacattgctactataaactttgttttttaatgcggttgcgtttttatccggcgttaccgcttgtccgttgccgtcgccgattgccatttttaagagttgtaagggttttttgttggcaatggctgaggtaatgagctgttccccatgttgggttaatacggaataataggtttttgtcatttcttttccttatttggtttaattgggttatttaatttaatcgggttatggataaacactgataatttcgcccatatattgaccaataaaatgatgtaatgggcatttaggcgatatagaaatagctaactgtgttaaatgtcttgataccggctttgcatcatcaacgagacggactacttcattgtaggtttgttcattcaatccgctttcagcgacttcaatcgtaatgctgaatgtgcctggtgtgccttgtgggtgcagatcaaaccattctttgacttccaccaaatagccgataggctcaaccactcgacgaatagcactaatcgtacctttgtatttgtggattaaaaaagcctgttgaatggcaatacgtttgacttgttctgtccaatgctcatcccatctatctacactgaacgcccacgctaaatacggcaacagctcaacggggcaacgctgaggattgattaagtctgcaataataataggattgcggacagcaaactgtaacacttctgacgctttacgctccagctcgctactgcctaaaggcaatagtgcggggacggttgggaacctgtcatcaataatcatctgctgtcaccaattcaagtgtaattttttcacaaaagccggcttgattattctgtaatacaatatcggcttgaggttgtagtaattctacacgttgcaccccttcaatatgcaaggacgcataaataccggataaggtaatatctcgtcctaatcgttgtttgtcttcggtgtattttttgattttttcctgtgcctgtttgttgatgggttcgtattccggtcctctgtagatgtgcagttttgcatgaatttgataccgatgaatactggcactttgtaccgttactctatccgctattgggcggatattttcatcattcagttttttggtcaccgcatttaaaaccgcctcactggcttgcccgtccccttttttggctaaaatagtgacagtcacattcgcaggtgagggcgatatcacagagacatcagcaacctccgcatgtgcggataacgcatggaatacataagctgcacgaggtcccgccacagacaacccctcaaacgctaattggcaacgcaaacgtaaatctgtgtcgctttctcgtttttcttctattggcggatttacgctatagtccgctttttgtatgatgagacgctgtacattaaaattagctgctatcacatcaagatcgctccctgttgcataagctaacattgttgcttttgctgcttcgttaatgcgtttgcgttctaataactgcaaataacaattttcttgtaataatttgttaatcggttcactttctaatgcgagtacggtttcccaataggcttgtttttctttagggtagagtgctataaattgagctttgcgttgttttaataactgttcaaaatcaaggtgttctaatacctttggggcgtctaatttcgataaattaactaattcgctcatgccgtttccctaatatgatttgattaaaatttatttttttgttgtcttttttgcggataaagtccatattggcggtgatttgtgctttctccggtactatatccactttaaaacgtgtaatttcaattctcggctcccattttttcaaggcgatcactgacgccgtggcaagttgtaacatcagggcttttgtgatgggacggtcgatcagctcaaaaatataactgccatactctcggcgttgtattctcgtcccaatcggcgttaataaaatatccgtgatagattgttttaaatgggcgttttcgttttcgcaatatctgcctgtgtgtttatccattagttaggcactcctgtcgttccgccactatctcctgcgtgtgtatgcgtttgtagcgatacaccaccggcggtaacatcgccttgtgcgttaatattgcctttaacacgtattgacccttgtacatcacttgagccttgcacactgcttgaccctttgatattgacgttaccgtctatatgcatatcttgcgtacaatgcactaagggcgtgttaagcgttacgctgacattcgcttcaataagtgcggttttaataccgcttacttttaattcacttgtcgcttggttgtattggataatggcattatccgcaaattgaattacatgctcatcaggcgaattgctcggggtgttaaattccaacgtgtagagggcactcaaaataaaaccgctgtttatttcacccgcaggggaaataagaatacattgttcacccggtgtaattggcgaccaaattttggttgtaccggcacgtgaagcacaccacggcaaccaatccgttaagatattacctgtttgtactttggcacggcgtttttcgtggttcacttctgccacgacaccataccgcacaatattttctaattttcggttaaattctgcttgcattgcacattcgcacattcttaaataaagtgcattttgagaaatttaaccgtgtttgagtagtatgccgggttgttaagccggaaataacaaaaaataaaatacattaaagggcggatataatccgcccctacagtaggggcgaatcacattcgcccaatcacattcgccaaacaaaagtaagttgattaattgttattttagtaacaggttacatcgtcggagttgaagtcattcagtgaaagtcagccaatccaaacggtaggcattttcacgaaaatgtttaaccgttaaaatcaaaatttggttattgggttcgtcataccaaaagagatagctataaccactttttctataagagacaaaaacctctcttacatttttcaaggtcttgccatctaccgacaaatcataggctttgccgttatttggtctatcttggctagcaacaaaagaattttttagcagttgcatgactgcatttgcttgctttgttgctcctacgtcagtcaaaaagttataaattcttgttaaatcagattgagcaagtcttgtgatgatgagctttacttgtgacatgggggcatatcctttggttcgtctgtttctaggctgtccacccaatccataaactcacttagcgtaatatgcaatcctgtttcctgataatcttggtaggcttgtatagctcgtctatcataggtttgtttagcttttaagcgttcaatgtgactatctacggcatctaacacaatactgtgaacgctaccgccaaaatcttgggctaattcttgcaaaattgctttgcggtaacccagttttacgctggttacttcttgattggcaagcataattaatttcctttagaacaagagaacaagtagtcgctcatagtaatacaaaagtattactcgatcaatgaaaagtcttcggaaatatgaggtttattgcattgacatccgcccctgcctaacgtcggggcgaatcacattcgcccccaattaattaatctctgtctcgtaatgcggatctcaagcgtgcttgtttttgttgttctattttaactagggctttctccacttctcttgcaatatcttccgcacgttgtcccgccgtggcatgaatattgattgtcacttgcataggttgaggtgtttcttgcaggtgacgtgttgttggacttaagggcggtcgattatccataacaaaaggctgtgcggttgcaacgcttaatcccattccggcggtcaacatggctttttttccgtaatttagggcgtttaataaggggacgccaaggcgtgatgttgcctctttggtcataatatattccccgccgtgaaatatgcccataggctgatattttccaccgtttccggcatatccgcctgaccatttattcaccggcggaacgtgattggttgttgtttgtgtggtgaaggtggcttttgtgtcggtgtctatgccgattttttctttaaaccacccccatactgacgaacctacattgctaatagtgtcttttactttgccgagggcgtttactatgcctgaacttaatttttccatcagcaagctaccaacatcagagaaactggcgggcagttcaacaccaaaataatttaacacggcggaaaaagctttgtagaataatccgataggtgaccaatctataatcaacttgctcacgccgccaattccgccgttaaaggcttctttgatgtgttcccaaatgcctcccaaaaactgaaaaataccgttccatacgtggaaaacaatattttttatactttcccatacctcgctacaagccgtttttagccattgccagcctgcaacaagtgcagcaatgactttatcccagtttttccaaagtaaatagattgcggcaattaacgcaacaataccggcgataatccaagtaatgggattggttaaaagtgcggctgaaaaggcaataattttagggattatagccaaaaaagatatccccaactttcctaaaaacaggattaatttaccaaagcctaaaatagtacgggcaacaggatagacaatgtagcctaaaaataatgataatgcacctaatgctcctatcaccaccgctattacacttccaacttttactatgtttgcggttaattcttggtttgcatttatccattgattaacgccacgcagcaaatcggttattttccccaaaaactcgcgtaaatcggtagatacaatgtcaaatattgaagttcctatagcttcttttgctgaagacagcgttttaaaatcaccagccacattatccgtcattgtacgactgactttttccgctgtgcctttcgcatctttaagcatattttcatagttttgaattgtgtcttttgcttgtgttaccaattcggaggcaccagctaacccaattttgccaaaaatattatcaaaatattcaaggcgtttagccgttcccattttttcggttttctgcattatctgtttgagaatttcgggaacttgttttaaattacctttggcatctttagtggatacaccaagtttttttaaggctttttccgcttcttttggcggtgcggctaaacgcacaaacatattttttaaagtcgtgccggcttgagaacctttaatccctacatttcccaataaccccgctaatgctgccgcactttcaaaagattgacctgcagcagtcgcaataggtgcaccttctttcatagtctcataaagtgtttcaagagaggtattagaggtagtaaatgtaagtgttaacacatcagcaacacgccccatatcatcagcctgaattttaaaacctgaagatatatcagaagcaatgtccgcaacacgagctaaatccgtacctgatgccatagacatgtttaacatagaagggacggaagatttaatttgcttgtcattaaatcccgccatagctaaatagccttgtgcctctgcaacttctgtttgggtaaaagccgtttcggcacctagtttaatagcctgatctcttaatgccttaattcgttccgcatctttgattttatctaatcttgttaaggcttgcaccttagaaaaagccttttcaaattcaatagcagtagaaagaatgctaccggcaaccatacccgtcgaagcagccgtaatcatagactgttgcccatattgttttaaattattacttgtattttttaggacttctatttttttattatatttctcttgctttttcttttgttgatttaatttttcaagagcttgagtttgtttttttatttcttgagtggttttctcaattttattttttaatctttcttgagcttgcgttaaccctgttttttttactcgctcttgtgcattttccaatttttttaataggtttttattggctattattgcttgtgaggttgattttatttgttttgatgtattgcgaaaaggagcggtcaatttatcaacggcatttagcaatacttgtatttttaaatttttgttcataaacaatcctttttttcatttattttttattatcaataatcacgatctcgagaacaatttattaatgtgtttaaataagattgacaacgtagaaaaaataaacaaagatacacaaaaaacacaggaggtttttatgcgacacgatgaattaaagtatgaaaattttacttttttttgggttactcatttgtactacatcagtgctatgtttaccgttattgtgttgtttggtatttcgctaaggatgagttgggaaaccttatctgtcattcattttttcagttccttgcttatttccgtttttttgctttctatccctgtcggtataggttgcgtgttattcacgtttgcattaacgcctttgatgttacttttggatacagtgctaatggcaattcaaaagaaatccggacgttatcatgctaaagaacaggtcgattatcaatttagccttgaatggggcataagtgccatcattcttattgcggttatttgctattttttaatataaaaagacaataacgacaaaaactacggtggttctatgaaaagtaaattgactgttaatgattttattgaccttatttttgtgttaattgtcgcgtgtccttaccttatttgttatttttattttgatttaagcgttgggctgacgtttatttttggcagtgttgctttattttttatctttgtgttgttttatgatacgtccaatcgtgataaaaattgttgccactgcaaaaataagaatttagatgatgacatctaatcaatattttcactcaatgccttaatcacaaacgcttcaatcatttctttgtcccgttccgtaaagccgagcaattcacgcttggcgtattgtactttgtgttctttgtgtcgttctactcttgctcttaatccatattgatgaatagtggcgatgtaggcggtatttccgctaaaccctagttctataccgtctttttggcggcgtagcttcatgtgccttgcttgggtgatttttttaaacatggcttgggttttaattctgcctttttttgaccgcactttttgcttgcgtggttgataggctgaaccgtccggattttgctgtgctttaattcgtttgcgttgactgcgtgcgagttctcgtccgatttgttggtaaagcagtcttagccgttttggtgaaacgtttttaagcagacgttcaaaagcggtttttacctgtagcatttcatccatgttgtagctcttttatttttctgtctttttttctatgatttcttggtatttttgtgagcttggttcatcaagatgtgtgatgatattttttccgttctcttcttttaccgatattcgttcggtgagttttaggaagatggatagatctatgctgtcgtggttgttgtgatcggcgataaagcggaatccgtcttttcttttgtccggattatggattaaatcaggttggttttctcggataaagtccataatcggggcaaaaatcatattgggcgatccgttaaaatcacgtacgataatatttaaggtgtattgcaattcataggaggaagatgtcgcaccggcactaacgacaaccccttcatcaatgaataattccaatttatcagggttggtattgaggtcttttgaggtgctttgtaacaaactgcggataagctctgcttttaacatgttctcttccttaactgattgacgagtatctataaatacgttggtgtttttcgataatgcgttgacaatctatacaacgacaatagccgttcttttggcgtatctccggtatttcttcttggcaatctagacagtatttcactgtgctttttttccgtgttttttgttggtgtttttggatggcaagttgttgcattatttctgtgtattcgttggctctgtctacgtgatcagtcatgttttttttcctgtaatgtgcggttgtagttttctatgcactgtgtaagtgcttgatttatcagcgtacatttttctatttcattgagtgttttatccaaggcaacgacgagatctccgttattttttagtgttattgtcggtttttggcatagttgatctgtcgggcaaagtagcggtatcggctctattaatctgatgtgttcgttcgttgaacaggcggataatgcgattaggcacaggctgaccgctccagctctcatattgtaacgcttgtttaatttcatcagtccgtttctccgcttggtgtaaatgagttaagaggttgtcattcagtttttttacttgttcttgatagtggttgagttgtttttttgcatgatctaattgagcctttagttgtttggtcgtttccttttcttggttgaggatgttgtttgcgttgatgagcttttgttcttttacctggttgttaaaatacaaatagccgttgatgctgataagtatagcaactgcaacgatgatgactttgtttaatgtggtgtttaaaaataatgcacggttaatcatggtattcacctaaacagaaggctttttcttttgctctgcgtgctactaagccgtttaatttttttccgcctgcgtaaatccagcgttcaaactggtgacagagttgaggggtaaagccttggtttgcttgtttaaataaggtgcttttttgcatttttccacatcctacattaaaggtaatggaaacaaaggcatcaaacgccccttgcggtagatttttgccgtttccatagcggtttacgcattgttccgccaggcgtaaatcatatgcccatcgttgggctatttctttgtcgctataacgttttttggggtcaatgttttttccgtttgcttccgtggagcctatgcccaccgttaagacgtcggcggggcagtgataggggtctcttctgcaaccttctacatttcctataaggtctaagccttgttgacttatgcgtaactcttgatggtttgttttgacaagggcaataatggcaactacgctacaaatagcccctgtcccccattttgtgaatttattcatggtcgccttcctttaagtcaatcttttgtttgagtgcggtttcttttaatttgatttctttgtttttgtaataccagttaatcagcatggtaaataagccgaataaaattccaaagatagctgcccagtctgccaaggtaaagccgctataaatggcgatggcagatccgacatacgcccctgttgtttcactattttttaacatgttaaacctcatttaatcccataaactcaatgtatttttgttggtggtcgtttgtatatcttcactattaggcaagataacgacggtaccaatggcgaggattggtaagttggctaatgttgggtttagctccaatacgtgttctactaagccaagcgttttcccaaaataacgatagacaatgctatctagtgtgtcgttttgttttgcataaaccattcttgccattagattaactctactatcattctgtgttgtcctactatatcgcggatagcaaagcgtccgtcacgtcttaaatcatctacgctttgttcaaagtcctgtgctttttccgccccttgtttggtggtgtcgtatgagcgatagcgttcgtttaaattggctaaggcgaaacaatacaccgctcttttgtagcgttgtattacgatattttcgccgttgattttttcgtcatccatgtcttcaaggcgatgaatgtgtttttcttttagggttttttggtaatgttttaaggcgttgttagcggttgctatggcttcgataacttccattttcaaccgttcattcgttaccgttccgtctattcgcattgcatttcttacatcaagtaaatgaatatcagggaaaaagccgttgttttggattgtttcgttatctgttgcttgttcttccgcctgtcgttttaagtcgtccatggcgtaatttttgacttttttgatggcgatgctgttatgcatgatgttcctttaactgtaaaaaagcgaggtgaggaaagtgatgaggcaaaaaacctttactttccgcctcgcttggcttgtgctaggttgctctgtttcgtgttcagcggggattttcttgcgttaattgttttcgcaatttttttacatccccttgaacgccaatatttaaattcagttctaatgccttttccaagtaggctaaggcggtttgcggtgctgatgtgagctttaatagtccgatttctctataaagtctcgctctactttcatccggtatatcttggtcatcagtgaggttcgctactcgttctaaataagccacgtcaaaagggcggttaagtttttgtgcaattttggctttatcagcaaattcttccgctagggcagaacataaggtgcggttaaagttttcgggtaatactaatccttgatgtatagcatagtcggcaatttgtaatgcgaggtgatattgctcacagtctattgaccaaattagccatgtcattaagacgttatcttgtttgccacttgcactacttaacgctccctctatccaaggtaaataatccggtaaaatgttctttttgtagtccgcttttaacgccatagaatgaatttgttttaaatcctttttatggcgtgcaagaagatacaacattctttcgtattccgtcgcttcgctaagtatgcgttcttcttgcatatgtgcctttttcgctgaaacttctagaaaatgccttcttgttggacgcattcacactttccttattcagcttttttcgctttgatgtcttcaggggcgtctatcatgttgatattttttaacaatgccacactttcatagttttcgacgacaaagtcatcattagaagaggtgtaatcttcatagcggtcatattctgcattatcttttaatgttcgacgcattgccccttcttggtaatagattgacaggttatcaagtcgggtaattaagatggtgccttttggtacaaaaggggcttgaacggcttgtaatccgcccactcgttttgtactcataataatatcaccggcaacttgttcactcgccttgctttgattgagcagagggaagtatttatcagccagcaaatcacggctcataatggcgactaatttcgtgtcatcttggaattgaggtgcgattaaatcgctgacagcagaaaacacaagggcatctaaatttttgtatgtttttccttccccgacttcaatttttccgctggactttttgtcttctgtcatgacacgttcaggtgcattgtcttcaatttttttcaaccagcctacagcgacatcttgtaataatgggtttgtctttctgttagaggttgctgcacgacttgttccgttaaaaccgatcataattctatccagtgccatgcgttcggcttttaatgtgccgatgcgtttagcgaaatcagggaattttgcccacatatccaagatggcatatttgagatgtgtatcatagttaatttgttggcagtgatacggaattttgtttaacgcatgaatggcttgcgttttacgtcctgtcgcattggtatctgttgttcctgcaatggtacctgatacgcctaaccctaagatttcaccttgttgttcatctaccggtacaatgttgatcagttttaggaaatccgagctttcttgtactgcattttcaagacgttgctgtacacttggcgtcacattaaatttcgcccctcttgcaattcttgagaaatcctcttggttatcgtttgaaataccttgaatgtaattcattaatgtttgtgcggtggtttttttcatcgtgtttaagtcctgataattgattaaaagaaacgtccatcattcatactatcgccactaattaaagggcgttcggtatagttggtatgcggttttttttctaacacggcgaatttttcgctgtgttcgtttgttttttctgtgtattcatttagcgtttgttttagcgtttgattttccgtttcaagtgcggtggttttttgatggagatgttgtacttcttttgaaagtaacatgaccgcttgatctatatcgttaaaacgttgtttatctgtccgctctttttggctaaacatcgctgtaatgcgttcaaagagagtaggtttttccggctccacgtcgttaaattctaagcagacttctacggcttcagtaaacaaattttctgtttttaatttgcgagcattaaacggattggcttttgctgttgctgcaaactgtaacatttccgtccctaaacttgccgggttatccgtgactgcaagacctactaaataggcttttcctgtgtcgctgaaattgatatcgatttcaattgaggtatacactttttgacgttttttgtttaacgcaatgagttcttctgtggggtcaatttgtgctaagagttgtaattttccttcgctttcttgggtttttaaggcgatgacatcaccgtaagcttgagcgtgcggttcttcttctcggtaaagataagatttgatgtgatctatattaatacgtgctccataggttttaggattatagctttctgccatttgttcaatccaaactcgtgaaatattacgtccgtctgtggtcgccccctcggttgcaacaacaaaccattttgatttgtattttttcatgggtgtattcctattttttcttttcaatttgtttttatactggttgatttcttttttcttgtcatttgcttatcaatgttaatttttttttgacagtttacaggggtcatgcattttcttggatttccttattatgctgtgagtgagaattaaggatggatagatgattgatataacgttagacagtaagcgtgaaagccgtttgctttatttttcaggttggcggattacggatattgccgacaaattaggggtgcctatttccacgatttcaagttggaaagacagggagaagtgggatgatatcgcccctgtcggtcgggttgaaaataccttagaggcgagattgaatttacttattttaaaagaagataaaaccggtcaggattttaaagaaattgatttgttgggtcgccaaatggaaaaaatggcaagaattaagaaatattccaacggtggcggtaatgaggttgatttaaaccctataaaagctcaagcgtttacctaggcaaacaaaatagaaatggaaataatggaaaatttataccaagatgtagctaacataccatttgagcacgtgatcgacagatacctaaacgaagtaacatcacaaaaaagtaggagtagagtgttccgaaataatcacatcatcattgattacttttaccgatattttttattcaccttaattattctacttttcaaaagattgtttataaaagaaagcctgttttcacaggcttcctatttatctcattagaatgttagctctgcactaagtttgaagttacgtcccggggcattgaagcggtttaaacctttgccggtgacgtaatcaattttattgcttgtaccaaattgtctaattgaacgagcagaatcccaagtgacatatttacgattagtgagattataaacaccaaattgtaagatcaaatttttgattggtttggcataagcgattacatcaaccaaagtgtaagcatcacttctccatctaatagagctgtcagtggtaacattagtattaccgatgttggtaggattagttattttttcttcattttgtgtttctctccacgtatcattatatgtatcagatgcttttttagcggcaacacgagttacatataaatccacaccaaatttaccatttgtattatgataacttagcccataaatgcttgtttttggctgaatagcattcattggagcggtaatattaataaattcatttgggtttgcagggtttaaatactctttaacttttactcgccctttttgcttactaaatttataactaaactcaaattcacttaaggctttatgcaaaatgctcaaatttaaacgagcgttaatctcaatcccactcgatttagcggattctctgtttatattttgtctaatttcatatggagttttaccaccatttgaatttttgtgatatccaatcgttctagcaaaatcaatgaagtttttatatttcgtttcaaaataattgaaggtaataaagccgaaatctttatagaaagttagtgcgatttgattcgttttagctaactctggttttaattgaatattaggtacaacatgcaaggtatctccatatttagggttaaaatcccccattttaaatgcgaaatatatttcatcggatgttggtgctctaaagccttttgagtgtttaaattgtaagagcataaaatcaaaaggatctgtgtttacacccaaagaataagaatgtgcagcaaaacttttttctttaacaaaagcatcaatatttgcctgatgacgagctaatttatttttctctgcgatttttttattttgtacaacagcttcattgtatgctactacagaatcatcatatttacttttttccttattatattcatttactttctgataaccataatccgaaaacttaggttcaggtaatttttttggtagctcgactggtttatatggatctttaaaatcatgagcgaatccaccgacaatatcatctggaatttttggggtgacaccggcagtatagctaggctgatatttaatttgatcataacgatagcccaactcgaaactaatacgatcattcaatttaaaatcatccgcaaaataaagggcccttgaagttgctttaacaggaactaagaaagagaaaatattgcttttaccacatagactagaataacttgttttacaattctctggatacaatgcccaccatttgacattgatagctgaatcgcccgattgattaaccatttctttttgggatttagacaaagagccaccgtaacttatattgtgatccgttttccctaatataagatattttgtgaaatctaaattaaattgtttggtgtttgtgttcaaagagcggtctgtccaaagattggtgttatgccccttagatgaaggtaaaaataatctatctgaatgtaatgcctcaccaccgatttttaatatcgctaagttacgctctttatctactttaaatcccaatcttttgggctgattgtgttcatcaataacggctattgtcgagtcaccatctctatctttgtctttggtatcacaactaatgccatcacaagataataaaagaggtgaatttgtttggtatttctcaatccacttactgttttccttgagagttaagtcagaataaacttgaccatttgaaattaattgctccgtaattattgttgcatatataggtatcctacacttatcagggtgttcagaagagatatctttataacaacttgttacactagtaggaacatcctttaaaactcctaatttttcatatttctcttttatatcatcaggtatcttctcgttccaagtatcaaatacatcttgactaacatattcataataagtttgtttctgatttgaatatttatatgtaataggatttccatctttatcaactagttcattatttttgttgtatttaattcccaatgggtttaatgagctattacatttatcattcccatcacaataatcttcatttctagctcttgttttaattttttgctcagaataagtaaatttcatcgtatcccataaaggattgctagaataattttcataagagaatgcatagttggttcgttttacctgatcattattatgacgatattcaagttcgggaggatcatttgatttttggagaccggttgcttttaatgtataggaaagatctgctcctttagagcgactatcatataaatcggcggtaacagtaaagcgatgattttctgtgggttgaaaagataattttagtaatgtactgtctaaatgtttgtgataaggatctgctttttctcttcttttaccttgtactgcagcatcaaaatggttataaccatagttctgtagttcatgaccatcacgttttgttttcactaataaggcatcaaaccatttataacgaccggctaaagtcatggaatctatatgctgacgatccgcactgttgtaaccttttttgtaagaaacataccagtttttctctgtgagaaaatctctagcgtctttagttttaaaaatgacagcaccacctaatgcaccgctgccaactttgagtgaattggctcctttagcaagttgcacttgtttcagagtttcaacttccgctccatttctcgtattattaaaattaccatagccttcaaataattctttaaagccctgagaactcaacgtttccgcttggtgtaaaccatctatcgtaatggctactcggttttcatcaacacctctcattgcatagccactggtaccaaagcgtcctttctctacagcagtgattcccgtttcataacgcactaaatcacgagcatcctgcacttgttgacgttttagttgttttgcacttttaattgtttcgccgacctttttttgttgtatatcttggtcatctaaatctgatacaactttaatctcacctaactccgtgatagttgagttagtttgagcctgagaggggggggaagtgagccataaacggacaataccattgtggctacgatagagagttttattttatgaggtgcatgaatttcaaacatatttctgccttgcattaaaaattaagtattttgatggccttcaaccaaatgaacgaagctcactaaatcttcattacttacttggaaagcttgaccaaaaccttttacaaataaaccttgaatcggtttaaaactaaataaataaaaatccttataagtactaatttcatcaattaatgcaccatggcgttctctaagaacagcaatacttgctttccattcttcggtttcacgttcaatcacacgagatgtggcatcaaaagataaacgacggcgagcaaaaatctcacgacttttactttcgtcttcaataagcattaaggaaactttaggtacttcctgtaaattacgtgcgtgacgggcaatagttgaaataaaaacctgatattctccattagaaatggcgaatggggcatagctcacattaggtgtaccatcttgtccaacggtggctaacataatggttttgctttgtgcctttaattcttgaatttctgggcctaatcgattttgtaatacttcttgacggtttgttgctgtcattttgatttcctcgttaattaaataaattgcttaaatttttctacttggtgcgggaataactgacgttgttcatcacgaccaagatagaccttaaaaatggtttgtccgttgttagcaataaaggcgatgttgtaactttctttgcctctaaatggcaaactgacaaatgcgatttgggcgagattgctgagtttcaaatggccatgtaaggtgccttcattatctttcatgttgaggttgtaataaccacgcccaaccatacctgttggaaaacgatctttaatttcaaaaattgaaccttctttttcaataatggttgtaaaagttccccattcgctaatttcagtcataatttccaccgctctttcagcagagaaaattcgcacaaattcctcaggtaatgcacaaagaatattgccttccggttgctgaaaatgttccgccatctcaagcgtgatagaaagagggttttgagcaatgtaatctgcgatttgctgttttaatgtgtgcatataagttttacttaaattagaaatttcatttcataaatgataattattcttaattgtatttgaatttatctactttgaaaagaggggagaagtggagttgaatcgataattattataattttttaatttaacgttttttagatacttgaagtctaaaataacaaccttatattacgaaaactgctacaagaattaaaaaattatgggaaagaaaaaacgttcagcaagctccagccgttggttaaatgagcattttaaagatccttttgtgcaaaaggcacataagcaaaaacttcgttcaagagcttattttaaattggacgaaattcagcaatcagatcgtttatttaaacatggtatgacggttgttgatcttggtgctgcaccaggaggttggtcgcaatatgctgttagacaaattggagatctggggcgagtaattgcttgtgatattttggaaatggatccaatcgtcggtgttgattttttacagggcgatttccgtgatgaaaatgtattacaggctttattggagcgtgtcggtgagaaaaaagtagatgtggttatgtctgatatggcaccaaattttagcggtatgccagcggtagatattcctagagcaatgtatttagttgaacttgcccttgatatgtgtaaacaagttttagcaacaaatggatgttttgtcgttaaagtttttcaaggagaagggtttgatgactatttaaaggaaattcgatcattatttaacacagttaaagtacgtaaacctgaggcatcacgtggacgatcccgtgaggtatatatcgtagctatgggttatatgggatagaaataactggtctgttgtcttattaataaataatagccaattaatctgataactttaaatccaaatagatttatagtatcttatgaaaaatttttaattactgaaatatggagttcaaaccttgaacgatatggtgaaaaatatagtcctttggatcgtagtcgctgtcgtcatgatgacagcctatcagagttttagtggaaactcatcaaataacgcaattgattacaccacttttattagcgatgtagaaaataaccaagtttcagccactaaatttaatgaggtcggtgaaatttttgtaactaaaaaagatggttcaaaatatacgacagttcttcctacaccgttagaagatcgtaagttattagatgatctgattaaatcaaaggtgaaaattgatggtgctttgcctgagcaacggggatttttatcgcaaattttaatttcttggtttccaatgatcttattaattggcgtttggttcttttttatgcgtcaaatgcaaggcggtggcggcaaagcaatgagttttggtaaaagtcgtgccaaaatgctaacgaaagaacaaattaaaactacttttgccgatgttgcaggctgtgatgaggctaaagaagaagtcggtgaaatcgttgatttcttacgtgatccaagcaaattccaaaagttaggtggtaaaattccaaaaggaattttaatggttggacctcccggtacaggtaaaaccttattagcaaaagctatcgccggtgaagcacaagtaccattttttacgatttcaggatctgatttcgtagaaatgtttgttggtgtaggtgcttcccgtgtccgtgatatgtttgaacaagcgaagaaaaatgcaccttgtttgatttttattgatgagattgatgcggtcggtcgtcaacgtggtgcaggtcttggaggagggcatgatgaacgtgaacaaaccttgaaccaaatgcttgttgagatggatggctttgaaggcaacgaaggtgtaatagtgattgcggcaacgaaccgccctgacgtacttgatcctgcgttgactcgtccaggacgatttgaccgtcaagtcgttgttggattgccggatgtacgtggtcgtgagcatattttaaaagttcatatgcgaaaagtgcctgtggcggatgatgttgatgcaatgacattagctcgtggtacaccgggatattcaggtgcggatttagctaatcttgtgaatgaagccgcactatttgccgcacgtactaataagaaattggttaccatgttagagtttgaaaaagcaaaagataaaattaacatgggaccagaacgccgttctatgattatgaccgataaagtgaaagagagtaccgcttatcacgaagcagggcatgcaatcgttggttacttagtacctgaacatgatcccgtacataaagtgactattattcctcgaggacgtgctttaggcgtaactttctttttaccggaaggggatcaagtcagtattagtcaaaagcaactagaaagtaagctttctacgttatatgcgggtcgtttagctgaggagcttatttacggtgaagaaaatatttcaaccggtgcttccaatgacattaaagtggcaaccaacattgctcgtaatatggtaactcaatggggtttttcagataaattgggaccgattttatattcagaagatgaaggcgaagtgtttctaggtcggtcaatggcgaaagctaaacatatgtctgatgaaaccgcacatacgatagatgaagaagtaagatcaatagtgaatcgtaattatcaaagagcaagacaaattctgattgataatatggatattttgcatgcaatgaaagatgctttagtaaaatatgaaaccattgaagaagatcaaattaggcaattaatgaatagagaaccggttgttgctcctgcaggttggactaataatgagtaaaatttatttgtagttttggcaacgtttagtaaaatgttccgactatgtcgtaggttctgattttttaataagggaaaggggttgaaagtcggtaatgtaacagaagtaaccccaaacaattattctttattttgggtagagtatgactttgggattttgttacgagacggcggaagaacagttaagaatattgaaaaaaacataataataggggcgatctactatagcccctatttttattgcaatttagataaagtttattttttatcgttactgagttttttattgaaaaataaatgtgattaaaaaatataaagactgagagtatagttatgaaaaaaatttttttaaaagaattacaaatgatttctttagatattttggattattttcatcatatatgtgaagcacataatatacagtattcactgggggggggaactttgattggtgcaattaggcatcaaggttttattccttgggacgatgatattgatgtatatatgctgtggagtgaataccaaaaatttgtctcagtttggaataaattatcacataatttctataaaatatctcctattgaaacttttgatggggatgttgtgggggaaatggctaaaatttatgatgagagaacttatttatcagaaaaacatagggcaagtcatatatttatagatatttttattttagattatgtgcctagtgatttaggtattttgtataaatctatgaagaagcatcgtagattaacacttaggtttaagtctttaaggaaacgtttttatcgagctaaagataagagtggttgtaaaaaaatatttggtaaattatcacaaatttattatgaaaaaatgcaagctaatctcagtcgattaagagaaacgtacaatgaaaaaaacagtgataatatcggtctttttttatctgactatgcttgctggaaaaaatcttatatgcctaaagaatattttcggtcgtttaaaaaagttaagtttgagaataaatatttttatgtaacggaatattatcatcagcacttaacagattattacggtgattatatgacattaccgccggaagatgaaagatctcctaagcatggaatagaagtatattggaaagagtgaggttacaaaattttatggcttatttttttatctaaattaacagcaaacaataaaacaatagataacttagagaaacaaaatgttgtaagttagattaattgaaggactggattttgtatgttaaatagacccagtccttttagtttgatacaaataatatttgtaataaatttctgtaatttttattttttaaagataatgtagatctgaaataacatgtgtaatgctattaaaaggttagtggggtgatacattttttagttaattgaaaaagtatcaccttcgtccattagattttagcccgatttttaggtatagccagtaacattggtcatgtttcctattattaaaatttcattgaaatactcatcttaacattacgtccaacacctgaaactttttcacttagataagggttgtacttgcgattaaagatattgtctatgcttagagaaagcttcattccgtgtattttcttaggttcccatatggcaaatagatgatgtaatgagtagccactggatttaggaagtgaccaataccccgcatccggatcattatcaataggtgatctatcttgtcgacggaaaaactcaccttgccaaccaattgatatattccatttgggtaggtttgtacctaatgtcattattgccttacgaggagggatctctgctatccaatctttgcttctagattaactaaaggatgatctgatatgtaagcccagtctagagagacactttcgtcagtcagtttgcgatataccagtttccttttccaagcaatatcttctccccatttctttatgtcggatatacttggtgagggtaaattatcacgcatagcggcaaacggtgtccaaccggagttattggagcgtacagctgaaagcgtaaatttttgcttatctgaaggataaaaattgacttttaataaatagctcttattgtcattttcagagtataagaaacgagatccgtcagggcgttttatgttttgactattacgaacggtcgtgtaaaataagccctccagattttttgcttgattgcgtagaaaaattgcaccgctccaaatattctgtttatcattcgtatggtaactatatttagcaaatccacctatattttgattttcattgagaaaatcgctcggatttttagttataaattttaaggttccaccaaatccgctattcccatattttgtagaaaagcttcctttatcaacctccacccgacgcagtaattccggttctataaatacagatccttgacgatatctttcaaagtttttttgtatcccgtctaattcaatacggacatcttcactatcaccaaatccccaatattgatattttgacctcccggtctaggtgaacctgacatattgacaccaggcaaaacattaactaaggctgcggcattgtcagcttgctgtcggtcaatattttttgttaatagtgttgaacgtccgatatcatactgttcattttgaactaagatgacaggaagagcgtcgtattgttgagcgattaatttgcttgtataaaacgtagatgaaagcaatatagtgatgagacggtagcattattgtccaaacttgatgtcgataaacatatagatgttgaaattaagcttgatgagcttgatttgacaagtgccgaaagtaaagcgacttatgcacaaatcaaggaatatatattggaaaaatttgatttaaaggtttcgaaactctatattgcacagattaaaaagaaatgtggaattgtactgagggagcattataataaatcaaaaaaagagaaacaggttattccacaatgcacaccggaaaaagaggaagctatcatggatgcgttaaagcattttaaaatgatttagtagaaatggagggtatttatgagatggataataaaaataattttgtttccaataatattacttctatcaatactaatttcttttctaaaatttataatcagcgttagtggaatgattttaggaatattatcattcttagtggtattaggttcgattgcagcacttgtgcaaaaagacacaactacttttattcaagcactgataatagcatttttgataagtccctatggattacctaaaattgcattatgggttacagcatatattgaatttgcaagagatagattgaaataaatataaagaaactaatgaggcgatagataaaatactatcgtcttttttcatgctaaaaattgaaaagaaaggaggcgacgatatgagtatgtatttatttgatgaacagcctattgttgcaaataaagcattagcaagagcattagggttaaatgaagccttagtattgcaacagataaactattggattgagataaataagaagtccggtaaaaactatcatgatgagaaatattggacatacaattctataagggcatggcaagaaaatgattttgactatatgagtgttgatacagtaaaaagaacttttgccaaacttgaaaaggcgggttatcttttggttggaaactataataaagatccaagagataaaacaaaatggtatacgataaatgatgaaaaattagaagaattatatcttgaattgaataagaaaaagctggaacatgaaagaagcattttagagaaagaaagtcaaaataccatgcacaatgcattagggcaaaatgcaccaatgcaatgatgcatatagcactgatgcattcaatgaaaatctaccaacgcattatggcaaattgcatgaaccgttaccagagatcccgagtattcatccaactgatattttaatgggcgtgggagtagcagttttaattaaatttatagtctatacaaaaggtaaaaatgcaaaaaaattcaggcaggggaaagagtatggatcagcacgatggggaactgcaaaagatattcagccgtatatggatgaaaagtttcaaaacaatatcttgcttactcaatctataaggataacgctgatacaatcgtaggtaactgtgatagtaccttgtttcttggtggcaagaaagaccacattaaaggaactttctgaaacactgggaaaagaaacgatagatttatataacacatcggaaacaaggagtaatcaaaagagctttggacttaattaccaaaagacaggtaaggagcttatgagccaagatgagattactgtaatggatggtggtaaatgtatctttcagcttagaggtgtcagaccttttctttcagataaatacgatattacaaagcacaagaattataagctcctagaagattatgataagaaaaatatctttaatattgaagactatatcaagagaaaaggtaaagccaagcttaataaaaatacttcaattataaggctttagcagttatttttacactgtatgggtatatttgatataatgatatatatacattttaaaatattagataatatatcctgaggaggtaaaactgtgctagaaaacttaaagctactaaaaaaggatatggaaaggcttgattggacaatatgtagttttatttttaactacaaggacattgagtatatcgttttagtaaaaagatttgttgaaaatgaaccaaggaaaaataaatatgccttggtaaaattacattttatgagatcaaatgatttgtcaaatgatttggtttgtgaagcaaatagtcatagtttattagtagatacaagaactatgagagaatactttgaaatagaatatgcagaaaatttaggtgacatattaagccagtttactgattattttggacgttatattcctattagtgttccaaaccatatttctgaaatagaaaaaatatctatggtaaattcattaagtataagtgatgcagaagatccaagaaagatatattgtaggaatgtaaagagaaatccagaggggcaaaaaagaaccatgtttaatgcagataaagcaaagtttttaagaaaatcattgtttgagcattttaaggatgataaaagtgtaagcttttgtttttcgatatatccagaaaaggaaaatgatgatgcagaaatattgaagaaatttgcaataaataattgattataatctagttgatatagcgacataataacatgatttattattttatattttgtgaaaggagtgtttgcaattgtattatcaagttttagttgaaattaaagaaaagattggcaagtcaaatcaaaataaagaaattacagttttagatgtggaatcaagggatgaggtgttaaatgatatagtcattccatatcttaacaatgaggaatttgtttttaatggttatatgttaaataaacgagaaataaataggctgaaggtaatgacaacggaacaaacagttaggtcgttatctcaatatgaaaatgataatatgccacagggacttataatgtatgtgtcaccgaatgacatacttacatatgataaatatataactgacgtaaccaaagaattacttgatgaaggtaagaaaacacaacatacaatattggataggcataaagatgaaataataggaaaagataaaaataaagtgtttattgttcatggaagagataatgaaactaagcaagaagttgcacgtttcatagaaaagatgggctttgaaccaatcatattacacgaacagtcaagtttgggtatgactatcattgaaaaaatagaaaaatacacaaatgttggttttggaattgtactatatactccgtgtgataaaggttacgaaaaagatagtcctaaggagataaagagtagagcaagacagaacgtggtttttgaacatggatttttaatttctaaattgggaagaaataatgtatgtgctttagtaaaagatgacattgaaaaaccgaatgatatatcaggggttgtttatataacttttgatagtaatggcgggtggaaaataccacttgcaaaagaaatgaaaagttctggatatgaagtggatttcaatttgtttatgtaattatagtaatgttttaagcagtaagtctaaaagatagatttgctgcttttttattactcaaaatcaggaggcaagatgataaggatcagaagtcccactaaggaaacaattaaatagtatgagcgttagcgattggaaaagaaaaactccggtcgctttttttattgaaaagaaaaggagaaatttttaaatgaagcaagaaatgattaacatcaacgccaacttattggcagagcctactttctcaagttttgaaaatgaaggagagaaagtggaagttgcaaacttcacgcttgtaaaaaagtacggaaagggaaaggagtacatcaactgtgcagcttatggagaaaaagcggataaagcaaaatcctttgaaaagggcgatttaattcatgtattcggctactttaagaagcgtgaaaaagagggaagaggaagctacgcagaaaacagaggataagagcttaacgaaatctccctgcttaaagtcttttggaatatcactcttttctccataagcggagcaattatgatatatcttgttaccatcatcatctttggatactacggaaaaattcgctaccttgaaggcttctctgttcttattttccctttcaactacatcaacctctccaacgatatttccgacaatattgataagattatccttttcttcctgaacataaggtaagtcttttatctgtccctgttctcttaaatcctcaatcatatagtcaaattcctcatgtagcaaattaaggctgtcattgtccatataagcatcatagagcttgtctagagcactttcatcattgatacctttttccatgcttataatcgccttcataaagtccttgtggttatcatttaccatatcttcaattttatctcttattgttttgtaatccatatttttatctcccttcatggtaaaggggaggttgccctccccttatcttaaaaattcctgttcttttgtagtgtgtttttcttccgttttactttcttcctgataagctcttatctgtcctaaaatagacggctttggtcagattagaacttccgttgatgataaaggcaaggaacatactaacattagaatactttcttcaaagctcttaaaggcaaaagaacagatgaaaggacaggaagaaaagaaagaatctgtacttggagctatcaaaaagtatcaggctgaagataaggaaaagccaaaagaaaagaaagaagcaaacaaagaagcagagagataaatttacggtcggtgtggtcttaggactgcaccgactcttttttgtttgcaagagttcgaataaagagaatatatttatgaaaaaagtatattttatggtataatgtaacaaatattagttttcttgaagggagtttgttgaatgaaaaaatttgataatgaaaaatatcaaatattagcaaaagatttaatgggggatattttttattcggagacatctaatcgaaataaaattgctaccattcgccagtatgcagaagtgatagtgagaaaaattttagatattgacccaagtcaaaagatgacgattggtgcgaatgaaatatctaaaaaaattgatactcttaaaaatagtaagtttttaaaagaagcgttagagaatattaaaaaggatggtaataaatttacacatactgagtatttagaagaggttacatctaatgaatttgatataattgttgataagcttttggatatgctttcttttatgcttattaattattttgaaacttataaatttggatcaagaaacgatgttttgcagtcattttcattgttaccaccaatagtacgatataaggtgctaatatttttatacagcaaatatcctaacaatgtacatgttgttgataaattagcgttagcaattgttaaagcatttagtagagaagaagccattagatggactgaggaagaaaaagataacctgattaatttaaatgcgatgtcagataagggatttgctgagattgcaaaaaataaagggatagaaatcgcagaaatcattagacttagtttgccttataaaaatatgtatgagttgtgtattgataaaattatgaaaatcggaaatgaaatagattcaaaaggtcatttatacattgattttgaaggtgcattgccgtattacaagcaatatggaattatagatgaggatagtgaagaaataaaagaatttaatgatattatggattttttatatcttggaagaagaacaaaattagacgattttattaaactaaaagagccatatttggttctaaatgcaattatagaggacgataatatagatgagagtatttagctataaaagactattcaaaaaacttattgatttagatatgacaaataatgaattgatggaaaaggcaaaaataagtaaaagcacattttacaaaatgaagaatgggcagaatataacgacggatgttttacttagaatttgcaatactttggattgtggtattgaagaaattatggagtgtagtgatgaatatagatagtgaagaatttgaaccaatatttatggatattaaggagcgatacctatcaggtgtaaatttccccaaattaatagttggaacagggctttctattgcaatgaatattccgggaatgtcaaaattggctgaaaaattggaggaatcgtttgaaagtatcggtgatttagagttacagaagcagtggaacaaatataaagggaagatcaaagatgaaggattagaagcagccttattagatgtttcaataagtgaagaatcgtttgtggaaataattcgagagataacgagtgaatttattttagatgaagaatataatcagcatcgtaatatattaaatgaaatttccggatttgaaaaattattaaagtacttattaggaactgtaagtgtaaataatcaagtaatcgatataatgactcctaattatgacagaattgtagaactaatttgcgataaattaaaactatcaactacattaggattttcggggaatatgtatcaaacttttaatgcaaatatactaaagcaaccttatgatttttttctaaaagcgttcctttagtaagattatttaagccacatggatcagttaattggataaaaaagaatgagagagaatatcagattaatgattataagttactaaaagataacaagtgctatatagatattattacaccaggcagtatgaaatataagtcaggaatgattaacggtatttttagatgtcatagggaaatttttaatgaattgataacagactctaaaaagaatttttctatatttatttatggatatggttttaatgaccagcattttaatacagtattcgaggatactcaaaaggatgtggttgtcttgacaaggacgattaaaaaatcatttttagatagagcaatgaaaaacgaaaactggactttattttataaatatgaagataaagaagaaaatacagaagaaggaaattatatggtatataaaggtaaaaaatataatataaataaggaattgtgggatataaatgtattttcagaaacttttttaggataggaggaaattatggaagatattcaaaattatttaaatcaagaaattggagttgttcaaaatgttgataccaagaaagtatctgtgtcagtagaaaaggaagaaattttaaataggttaaaaataaatgatatagttgttttatctggaaataatgcagatgaaaaactaattggaatagtaactagagtaagtaaaaagagaattgacatcgatgatgaagaagctgaagaacaagaatattcatttaacttttgtaatataactttagtaggtacgttttataaaaaactgtcttcaactaaacaaaatatttttaaaagagcggtgaatacttaccctgaaatcaatagcaaggtttatttggcagatggtaaagctctctctattattatgaactctcttgaaaatgagatatcttcagaaaaaagattaattattggcaaatatgcaagtaataaaacggttgaagcaattttggatggaaatagattttttcaaagacacgcaaccatagtgggtagtactggaagtggaaaatcttttactgtagcaaatattcttgagaaggcgaatgagttggaacatgctaatttaattgtttttgatttgcatggtgaatacaatgaattaagttatgctgaacagataaaaatttgtgactctgaggatgggttacatattcctctgtggttttttaattatgaggaaattcattctttgtttattgaatcttctgaagggacatatacaaatcaaagggcaacagtaattaaatatattttagagcataagaaaaggtatcttgaagaaaatatgactgaattttcatcagaaataattacagcagatacgccgattcctttttcagcaaaagggttaaaagcatatttagaggatgaaaatataaaggaagaaacaacaggtgaagtatataaaaccggagataaaaaaggacaagaaaagacgaaacaaggtcaatactatgggaaattaacaaaccttattacgagacttcagacaaaaatagatgataaaaaatatgggtttgtatttaatgagaataacactggaagagctgaatatttgaaagaatttattgataaaataatggggctagataaaaaaataaaagtaatagatttatcagaagtcccatcagatatgttacctataataataggtattgtaacaaggttggtatatgaagttcaattttggatgtcgcctaaaacagatgagactcgacatcctatagccttcatttgcgatgaagcacacttatacatgccaagagatacaacaaaattgaaagcggttgagaacaaatcgctggagatatttgaaaaaatctctaaggaggggagaaaatatggtgtttcattggtgattgtttctcaaagacctgcagaactaaattccactatcatatctcaatgcaataatattataagtttgaaaattacgaatgatagagataaatcggcagtagcaactatgttaactgattcattggtaggtttggttgaaacattacccaatcttgatgttggagaatgtattgttattggagattcgattaagctacctactaaaattattttagataaacctaaagaagaacctaaaagctcaactattgatttttgggatcgatggatagacggaaaaggtacagttttcgatattgatgaagcaattaagtgtatgatcaaacaaataaggtaagaggagaatatagaaaagctatctctccatctccttgcccatataaattccgtaattttttcgtatcttgtaaagttcgtccatagtagattttgtagaagaatactcttgcataagggtattctttttttcttgcaatttatcaagttcagctaaaatatcttttgaatttggaataagattttttaagctctgaaagggcgttttcatatagagtgatttgagttttatactcttcaaaaaatgcattgtcagaaggattagccttatattcattgtagcacgccctgtatttttttacggtatgaacttgttccatagtggcagaaagcaacagcatttccttatcaataaccttgattttatcctgtaaattttgcctttcatcggctgctttttggatgtactcatcaagttgcttaacggatttaataccttgttctctgaggaagataacagactcagccattgtattaaggttatgtttggttgcccaatattcatagcctttgctttcttttactttaagatttgtgttcatatcaataaccttgccgatgcgttttttgacggcaggagtcttgatatactctctttctgcaatacgttcttttaatctttcttcggtataatcttctccgattgttttagcccttgtaaatctcgccttatcttttggcttaaaagcaatgtgtttgccatacttaatttcatagtcaagatcagccatcttttttagaaactcatcccaatccttagactgttttatcattctatcaatgtcaaattgaagcttgcttttccaagaagccccatgctttgtctgttcgttttcataccaagatttaccggtagtcttatattttttcttatagctttcgtaaaactcgtcaacgatggataggctattttctttgcatagcttatcgctctgataacggattttatgatagctttttttattagactggtagcacctacctgttaccatatttacattgttaaagatgatgtgattgtgtatatgccctttatctatatgggtagataagacaaattcgtactcgtctttgagtatctttgaatttcttattaaattataccagaaggacaccataatttccacatataacctgacaaatattgaattataatttattattaaatataaattcagtattgggatggaaagaggtgtgctatggcacaagtattaaaagaagaagttagaaatagaatactcgaagcagcagaaaaagtattttataaaaaggattatagaggtgctaaattaacagatattgcaaaagaagcaaatattcctgtggcactcatttatacctattttaaaaacaaggaagttttgtttgatgcagtagtaagttctgtttatataaacttcgagtcagcttttaatgaggaagaatctttggaaaaaggttctgcttctgaaaggtttgatgaggttggagaaaattatattcatgaacttttaaaagagcgtaagaagttaattattttaatggataaaagctcaggtactaagcatacagaagcaaagcaaaaactcatatcgcaaatgcaggttcatattgaagtaagtttaaaaagacaatcgaaacaggaatatgatccaatgcttgcccatattttagccagtaactttacagaggggcttcttgaaatagcaaggcactatcaaagtgaaaagtgggcaaaagatatgttaaaacttattgcaaggtgttattacaagggagtggaatccctataatcagcactaaaaaaatagactttgcgtaatcagcaaagtcttactttaaatcttaatactaaattaaaattcaatattattcaattttgaaaggagagttgttcatgccggaaaaagaattaaggaaaaaagtgattgggaaaaatggtttacccaattcacttcttgctttaaaaatagtatttgatttgataccacaaatcttacttgtatatttgattagttctttaatcacaaacaatattaacgaaggtaatttaaagtatatattcttgggaatctttatatcgtttgtattaaaaggcgtgttttactattttgcaacaaaggttgctcatgagaaggcatacgaaaaattgacagaacttaggatagatattatcgggcatctaaaaaaactaagtttgggatttttcaaagaacataatacaggggagcttacgaacattgttcagcatgatgtggagcaagtggaagtataccttgctcatggtcttcctgaaataatggcagttacacttctgcctatgtttcggcggtagatagttacgaaagactttcaagaattttatatgcagatgtaatcccggataaagtgaatggaattgttccgaaagataatgatatagcttttgaaaacatagatttttcctatgaaaaagatgaatttaaaatggaaaaattgagcttttctattgctgaaaaaacaatgacagccttagttggagaatcaggtagtggaaagactactataatggatatgtcatattttgtctttcaagattcagactaccagttgttttcggaaagtgtacttgatgaaatgctgcttggtatttcaagtaaagataaaaaagaaaatacccaaaaggcaaagtctattttgaatgtacttggcttagataaatacattgatagacgatgctgtcgctgaggtaataatcaagttagtaagcaatcctaaatttgcgtctatgatacaagaaaaaatcaatatgaaggttgatacatcagctattgaaaatgagatagataattaccaaaaagagctgagaaaaagtcattctacaaagtttaagctcattgaagaaatagataacttagatgttgatgataaacattataggagaagaaaaaccgatttagatgacaggctttatcgtatgtatgataaaattgaagagttagaaggtcagttaatagaagctaaagcaaaaaaagaaacaatagaagctgagaaacttactggcgatatatatataaggttttgatttattttgacaaactttataaagtcatgaacgatgttgaacgcagacagttaatagaatcacttatttcagaaattcaaatttatgaagagaagcagccaaatagacaatggctaaagtccattacttttaagctacctatcatagatgaggatctaaatataagttttgacaatgatgagtaagttgatgtatgaaggggggggaatttaacaaatttattacacatgattatcgtaattaatgtaaataattgggaatataactaattatcattttaatgtaaaggtttttatataagggaataaaaaagaatatgaattgtataaacattcaatatagagttcaaaggtaagctactttgggcgtttttcagtgttttattcattatttttgtatttattctcaaaaatttttttatttttgttcattccaatattccgctataattgaccgcacttttaacttgattgcgtagcagagcaaatgaaattacaagcaaataataaaactttagatctttcaaatcctcagattatggggattttgaattttacgccggattctttttcagacagtggacgcttcttttctttagataaagccttatttcaggcagaaagaatgttatcggaaggtgcgagtattattgatattggtggtgaatccactcgttctaatgcggcagaagtaagtttggagcaagaattggatcgtgttgtgcctttagttgaagctgtaagaaaacgttttgattgttggatttcagtagatacctctaaagctgaagtaatgttggaaagtgctaaagtcggtatggatataatcaatgatattcgtgcattacaagagcctaatgccttagagacagcggtaaaattagggttaccgacttgtattatgcatatgcaagggcaacctcgtacaatgcaacaaaatccccaatataataatgtagtgcaggaagtattggaatttttacaaaatcacaccgcactttgtttacaagcgggcatgaaaaaagaaaatattatttgggatcccggtttaggttttggtaaaactgtgcaacagaattataaattattacagcaagttgcccgattttgtcagcaggatattcctgttttagtggggttatcacgtaagtctatgattggtgcggtgttggataaacctgtaggccaaagagtaataggaagtgcgacaggtgcattacttgcggcaatgaacggtgcaaaaattttgcgtgtacatgatgttgatgaaacattagatgcattgaaaatttggcaagcaacagaacaggcttagttttaaagagttgttctacaataagttgatttcacagagtgaaggataattttgcttctcttgcgttgatgaataatcaaggaacgaaaaatggcggaacgtaaatattttggaactgatggtgtgcgtggcaaagtaggaagttatcctattactcccgattttgtgctgaaattaggatgggcagcaggtaaagtgctagctacacagggaactggtaaagtcctaattggtaaagatacacgtatttccggatatatgttggaatctgcattagaagcggggttggcagctgcaggattatctgccgcatttaccggaccaatgccaacaccggcaattgcttatttaacacgtacttttcgttcggaggcgggaattgttatttctgcttcacataatcctttttatgacaatggaattaagtttttttctgcacaaggtacaaaattacctgatgatgtggaagaagcaatagaggctatgttggaacagcctatggattgtgttgaatcagctaaattggggcgtgcaagccgtattaatgatgcggcaggtcgttatattgagttttgtaaaagtacttttccggcacatttaagtttagataagtataaaatcgtggtggactgtgcaaatggtgcaacttaccatattgcaccgaatgtcatgcgtgaacttggtgcagaagttattgaaattggtacgcaacccgatggtatgaatatcaatgaaaactgcggtgcaacagatatcaaagcattacaaaatcaagtattggaaacaaaagctgatatcggtttagcctatgatggcgatggtgatcgcttaattatggttgatcattttggtaataaagttgatggcgatcagatcttgtttattattgctcgtgaggcgttacgttcaggtaacttaaaaggtggcgtggtgggcacgttaatgagcaatatgagcttagagctcgctttaaagcaattgggaattccatttgttcgtgcaaatgtaggtgaccgctatgtgttagaaaaaatgcaagaatataattggattttgggtggtgaaaattcaggtcatattattattgcggataaaaatactaccggagacggtgtgatcgcttccttggcggtattagctgcaatggtgcaacataaattgtctttaaacgaattagcaagtgcggtgaaattatttccacaagtgttaattaatgtacgttttgcaggtggtgcaaatccattggaaagtgatgcagtaaaagcagttgcaacagaggtcgaaaaacaacttgcaggcaagggcagaattttattacgcaaatccggaacggagccattaattagagtgatggtggaatgtgaggatgctgaactggcacagctcagtgcagaaaaaattgctgaggcagttagatctaattaggtgtgataggataatgaaaatatttgtaatgcgacatggcgaagcagaagtgatggctaattcggataaagaacgccgcttaacctctcgaggtcggttgcaagttagcgaacgaggttattggttaaaaacggttattcctgattttgataaggttttggtaagtccttatagaagagcggtagaaagttttgaaaaaatcgatgaggcttatcatcatcaactaagttcaaagcaggaaatttgggaaggtattacaccttatggaagtagtcatttggtgatagattatttatctgtattggcaaataaaggtgttgataaggtcttgattgtttcacatttacctttagtgtgggatattgtcacagaattgtgttctaaacgtagccccatcagtttttatccctctacaattgttggtttacagtgggattgtgagcaaagtgcggtcattacggagataaaatatccggagtagtaatatgcaaaataacgatttcttatccgcctttattttttcaaccagcgttactctgccgacattgttaatgctgatgttgggtgttacgttacgagcaaaacgagtcattgatgatcgtttcagcggacaagcaactaaaattatttttaatattaccctgcctgttttattatttttaagtatttttaaaaatcctgtggattatagccaacaagtgcctcttttattggcaggagtggttggtacattaattttatttgttggtgctgagatttttgccgcaaaatttgttgcagataaacgtgaaagaggcacttttgtgcaaagtgtttatcgaggtaataacggcattttaggtttagcattttgcattaatgcttatggggatttagcgttggcaccggcgtcaatttatgcggctgcattaacttttttatataatattttaggtgttattacgctaagtcgttctttatccgatggtaaagtcggtgtcaaaaaaattgttttcaatgttttaaaaaatccattaattattggtatcttactcggtattttggcaagttttaatcaggtggtttttccaaaagcaatcttgacgaccgctgattatcttgcgagcatgaccttacctttagcattaatttgtaccggtgccagtattgatgtgaaaggattatttaagattaatgcggtatctttatgggcgagtatcggacgattactggtcgcacctatttttatggtagtgattggcaaagttttaggtatcaccggtatacatttaggtatcgtgttattgatgtcttcaacacctttagcaacagctgcttacgccatgattagaggaatgggcggtaatgctgtaacagctgcgaatattattggattgacaacttttggatctatgtttagttctgttacaggtctgttattactgaatcaaataggctggatttaaataattttttcgtttttatttgattttgttattattcggtaacgtttatatagtgaatctattttttggcaaaatataaccgcactttggacttatctataaaagtgcggtttaaatttataaatcaatgcaacaaatcattcaaacattttccggcaacggcgtattaagtaaaaatatcaaaggttttcgtcctcgagttgagcaaacggaaatggcaaaagctgtaggtcgggcaattagtcaaaaaagtactttagttgtggaagccggtacaggaacaggaaaaacatttgcgtatttagtcccggcgttattggcaaaaaagaaaacgattatttccacaggttcaaagaatttacaagatcaactttttagtcgagatctccccactataaaaaaagccttgaactatagcggtaaaattgccttattaaaaggacgagccaattatttatgtttggaacgcttggaacaagttattgctcaaggcgttttggggaatagagaagtgttggcggatttggcaagcgtacgtcgctggaataatgcaacaaaaacgggcgatttaactgaatgtgttgaacttgcggaagatagccctattttaccgcaactgaccagtacggcagaaagttgtttaggggcagagtgtcctcattatgcagattgttatattgcccttgcacgcaaaaaagcacttaatgctgatttagttgtagtcaaccatcatttattttttgccgatatagtcgtgaaagaaagtggttttggtgaattaattccgcaagctgaagtgattatttttgatgaagcacatcaacttcccgacattgcaagtcaatatttcggtcaaagcattacttctcgccaattttttgatttatgtaaagatattaatattgtttatcgaactgaaataaaagatatggcacagcttggtgtagcttccgacacgctgttaaaagcggtgcaagactttcgtttattgctgggtgaagggaatttaagaggcaattggcgtgaagttttacgccaaagtgcggtagaaaaatcgttcagtttgttacaagaaaaagtagattttacagcggaagttatcaaattagggttaggacgttcacaaacgttagacagtatttttgagcgtattattcagctgaaagcaatgcttcaacgcttacaagcaacagatatcgtaggattttgttattggtatgaaaccatgggaaggcaattcggtttacatattacacctttaaccgttgctgataaatttggtgagcaaatgaaagctaaagaagtcgcatggatttttacctcggcaactttagaggtggcaggaacgtttactcatttctgcaaacgcttaggtattgaaaaggcggaacagcaagttttacccagcccatttaattttaccgaacaagcactattttgtgtacctcgttatttacccgtcaccaatcatcgtaacacattaaatcaattggctgaaatgttattgccggtgattgaaagtaataatggatgttgttttgtcctttgtacttcttatttgatgatgaaaggattagctgagtattttcgtgaacatagtcaattaagtgttctgcttcaaggggaaacttctaaaggaaaactgttagagcaattcattaaagaagatcattctgttttggtggcaacgtcgagtttttgggagggagttgatgtgcgtggaaaagctttatctttagtgattattgataagttaccttttactgcaccggatgaacctttacttaaagcaagaattgaagattgtcgtttacaaggtggagaccctttcaatgatattcaaattccggaagcggtcattgccctgaaacaaggtgttgggcgtttaattcgagatgttactgatcgaggtgcggtgattatttgtgatagtcggttggtttttcgaccttatggtgaactatttttacatagcctgcctaacgcaaaacgtacccgagatttaaacaaggtggtacaatttctggctcaaattaaaaaggagaaataacagaatgatgacaactttattagcacttgatacatcaacagaagcctgttcagtcgcacttttatacaaaggagaagtcacctattttgatgagttggcacaacgcactcatgctaaacgcattttaccaatgatcgatgagattttggtgcagtccggtattcaactaaatcaattagatgccttggtatttgggcgtggaccaggaagttttaccggtgtacgtgttggtgcggggattgtgcaaggcttagcttttggggcggatttgcctgtgattcctatttctaatttaaccgcaatggcacaacaggcttatgagcaatatggggcggaacaagttttgtgtgcaattgatgccagaatgaacgaagtttattttagtcaattacaggcagaaaaagtgcggttggaaaatactgattttgttcaatggcaagagttagtcaacgaacaagtttgttcgccacagcaggccttagctcaattaaaagatatccagattgaagattggacaatggtcggtactggttgggaatatgctgaattcaccgtagcgggattgagtgagaagacgcaaattgatctaccatctgcccgttatatgctttctctagctttgccttcttatcatcaaaaacactggataagtgcggtagaagttgagcctgtttatttgcgtaatgaagtaacttggaagaaacttccgggacgtgaataattcatgatgtgtttatttttctattgctcgtgtacttgctgaattttattttgaagaaaatcttgatttataggggaagattgaaagatgttttattgcattgaggtttttgctaagagaaataaatctgctcaaaataaaaaattgaagtataatgcactcgatttttcacagaaaaatagtaaaaatgatagaaatatcagttaattaaagaggataaataccatgcaaaaaccttggtttcaaaattaccctgagggctcaccgctggaactggacacttcaaaatatgaaagtttgttagacatgtttgataaagctattcgtgagcatcctgatcgtccggcttatgtaaatatggggcaggttttaactttccgtaaattagaagaacgtagtcgagcttttgctgcttatttacaaaatgaactaaaattaaagcgaggtgagcgtgttgctttaatgatgccgaatttattgcaatatccaattgcattattcgggactttgcgtgcaggtttggttgtggtcaatgttaatccactttatacaccgagagaactggagcatcaattacaggatagcggtgcaacagcaattgttgtggtatcaaattttgcgtcaactttagaaaaagtcgtttttaatacgaatatcaagcacgtcatcctcactagaatgggggatcagctctcttttggtaaacgtactttggtcaattttgtagtgaaatatattaagaaattggtgccaaaatataagttaccgagtgcggtaacatttcgtgaagttttggctgtcggtaaaaaccgtcaatatgtacgtccacaagtggaacgcactgacttagcctttttacaatatacaggtggcacaacaggtgtggcaaaaggtgcaatgttgacacatggaaatattattacaaatatttttcaagcggcttggattgcctcaccctttgtaggcgatcataaaaaacagcgtaaagccattatagctttaccgctttatcatatatttgcattaacagcaaactgtttactttttattgaattaggtattaccgcagttttaattactaatcctcgtgatattgacggtttcattaaagaattaaaaaaacatcgttttgtagggataactggggtgaatactttatttaatgccttgctgaataacgaaaactttaaagaggttgatttttccgcattgaagttgtctgtgggaggcggtatggctatccaacaatctgtagcgactcgttggcatgaattgactggttgcaatattattgaaggctatggaatgacagaatgttcgcctttaattgcagcatgcccaatcaatgtagttaaacataatggaactattggtgttccagtaccgaatacagatattaaaattgtcaaagatgacggttctttagctgaacttgatgaacctggagaactttgggttaaaggtgagcaggtaatgcaagggtattggcaacgtccagaggcaacggaagaagtgttaaaagacggctggctggcaacgggtgatatcgttattatggataaaacttatagtttacgcatagtagatcgtaaaaaagacattattattgtatctggttttaatgtttatccgaatgagattgaagatgttgtaatgcttaatcctaaagtagcggaagttgttgctattggtattccggatgaagtttcaggtgaaaaaatcaaaatttttgttgtgaaaaaagatgatagtttaactcgtgatgaaatacgccagcattgtcgtcaatatcttacagggtacaaaattccgaaatatattgagtttcgtgatgaattaccgaaaagtaatgtaggtaaaattttgcgtcgagtattacgtgatgaagagctggcaaaacatgcgtaaaaataaatatcaagtgggcgattaaacgcccactttttgtgtatcgttttacccacaatgatgtagcaatgagaaaggttattgaataatagataattagcaagtatgtccgttttaataaaagaaatccaaaattcaccgcagtttcaattgattactacaaatgatcgtttatatgagatttgccaacaggcacaacaaaaaacggtgattgctttggatactgagtttgttcgcaccaaaagtttttatcccaaactaggattgattcaactttatgacggtgagcaagtgagcttaatagatccttttgagttgaatgatttttctccttttattcaacttttagccaatcaaaaggtcacaaaagtattgcacgcttgcagtgaggatctggaagtttttcaacattattttcagcagttgccaacgccaatgttagatactcaaattatggcggcatttttgcaacatggcaattccattggtttagctacattgctaaaacattatttcaagctggaaatagataaagggatttctcgcactaattggcttgctcgccctttgtctgacgtacaattgcactatgctgctgccgatgtatggtatttattgccattatatcaacgtatgcaacaaaaattagctcaaacctcttggcaaagtgcggtgcaaaatgattgtgaaaatttgttgaaaaaatatactcagataaaagatagtaacaatgcttatttttctatatctggagcgtggaaattaaactctcaggaattaatgcgtttaaagctgttagcaaaatggagacaagaagaagcgataaagcgtaatcttgcattaaattttgttattcgtgcagagcatttgattttattagcacaacataatccaaaatatacttcacagctgttatccattggtttatctctgctggaagtgcgtattcatggtaaaaaaatattacaactcttagagaaagcaaacaaagcaccggcgtatgactatccaccaccaattttgcgagtcactgatgatcatcgttatcgtgtagcaattaaattgctacaagcaacgttacgggaaatcactccggcagatttaccgactgaagttttgtcaactaagcgtatgttagatcagctgataaagtggcattggattaaacaagacaatcctcatgatttacctgatttgctttgcggatggcgtagggagtttggattattgttattaaaggctttgcattaattagatgctttcttaaattttttggaacgaactcaagaaatcaaagggtatacaaattgataccctctatatttttagacagggaagaatgttgatctctcccctatatgtcaatctttaatcaagatatttgattactttaattactttatttacccctgaaacatgacgagcgacttctgcagctgcatctgcttgagattgagttaaatttcccattaagaatacttcaccattttcagtaatcactttaatatccgctgatttaatatttgaattgacgaataacttagatttaatttgtgtagtgatccagccatccttactaatttgtccaatagtaattggttgtgcaaggcgtaactcattatatacttcgtcaacaagttccacccctctggctaaattagttgcctgtacttttaaactattattcggaacttgtccgattaataaaattcgggagctataagaaactacattaacacgcccttcagcttttatttgtgcatcttttttaatcgctgacaagactttttcttccagtgtttcatcatcaatttgagtacctactgttctcggatccgttgcaacttttaccgcaactgccgtaccggtagcaataccaatcacagtggctgttgcacaaccttgtaataaaagagctgaactcagcaatagccctaacgttttatttattttcatctgatttctccttgttgaaattttgcctagtttgggttgaaacatggctttttgtcaagaactatgaatgtgaaaataatgaataatcaataagctcacataatgtgttaataattagcagatgattttcaagaatacgactttccttaccggtcggtactgaaatttctaaatcatttgccgttaaaaatccttgtatatgaccgttattttcaccggttaaagcgataatttgtacatctttatttaatgcacattgcaatatatttagcatcgtttcttcattgccgaaaggagaaaaaataattaatagatcaccttgttgtgcaattgcgttaaattgtctttgatacaacatagtatgacaattttcggaaataatggcagaaccgaccgcactatccaaacttagtagaacggaaggaaagctagggcgttccaattcatatctattgagtaaatttgctactaaaaattgtgcattagcataggatctaccatgcccactgacaataattttattacctttcagcaggcaatttacaatatgttgagttgcctctacgatttttgttgcaagtaagctggaggaagaaatttgagtttgaatactttccgtataaatatctttaactttttctaacataatttttattcatcaagaaaattaggtatccattggatatcatttgttgttgctccaaaagcgaccagatcgaaacggcagtccgcatcttctaaactggaatcatattgtgctaaccataggttggctgcatcaagccatttttgctgctttttccaatctacactgtcaattgctgaaccgaaaatttgatttttacgctgacgaacctcaacaaaaacgatcgtttgctgatcttgcataatcaaatccaattcaccgcagttaaagcgttggttagctgcaataaaggttaaaccttgtctctctaaaaagaggcgagcctgatattcaaaactcgcaccttgttgacgtttggattgtatcattcttcgttaatcagatagatgctgtcatcttgctcgttaagcggatagatactgccattttgatattggaaccaagtcatatcacgttcaacattacagttagggccggcactgagttttcctgttaacccatcaatggtaaatccgggaatttgacggaattcattaaattgatttattaataaccaagcatcataacccatagcatataaatgcattaatgagtaatcattattggtcattttttcaatttttttatattgttccgattccctatctttgaagaacggaatatcactaaattgcagattattcagaaacaaacgatgttcaggaccactgttaggcgaattactacgtgaacttgcataaagttttagggtcggattaatattatccaacactgctttaatttcagctaattgtttgttattagcaataatatacacgccgtcagtactttcacttaaccccgattttaatgcaaaattaatatctgcagtttgattatagaatttaatattggcatcagtacccaatagttgttgccaacgtagagtaaatgccgctgccgtgcgtcgccccagattattttgcggtactaaaacaagtggaatacgtactgtatcattccacattttacttgccgcactttcagcttcatcttcaggcgatagtccataataacaaaggtgttcaattgcccgtgcattaggcgtagagttcaacgctaacacatttaaatcttgtaccaaatacggattattgactataacatcaacattttgtttgagtaatggtccgacaagagtgttaattccctgtttttttgcttgattaataatttgttctatagacattttcattgagtcaaatacgtgaacttgaacattgtaattgactttggcatcatcaaacccgtttttaattgtttcaccgataagtcgtgtattgccgcttaaagggagtattagaccgacttgcgttaaagtagtttgttgaaaattggcaagcccttgtaattctgtaggtaataaatgtgctgccgtatgtgttggataataatttttccaagtcagtaatgtttgaattaattgtgcaggttgattaaggttatcattgtatagttgagctaatgttaaccaaccgctcaatgtaatatttccttccgcatcagtattatttagtacttcactatctgtattgcgtagcaatgcccaagtgcggtcattattttgttgttttcgttgaatatcacttaaaaaattatccatttgaattcgagcttttatcgctgaaatattatcatgacgattttctgcaatacgagaaacaatctcataataacgtgatttttgtgaaggactaagtgatgtcaagtgaattaaagataattgatattctgccgtttcatttttgcctttaacggcagaaatatgagcttcaatcagggatttatctagtttttgttcatcatttaaatctatcaattcagcaagatatgcttccgcttgcgggattttattttctgttactaaaactcgagcagctaaaagtttataggtttgtaaatcttgttgattttgtgtttgttcaattttccgaatgtaaaaatcagaacttgcattggcatcattttttaagcttgccgtaaagctactgcctaataaattgacacagcctgctaaaaaaaacataactaaaatcgggagaaagcatttttttaagcgtaaaccttgcattaaaatagataacataaattgctccttgagtatgtgcaatgtaaaatgcacggtgatcttacttatctcaccaattaaaagcaaataaaagaagtgaaaaatgaataattcgacaggaactctatacgttgttgcaacgccaatcggtaatttacaagatattactcaacgtgctttagatgtatttaccaaagttgatttgatcgctgcggaagatacacgtcatagcggtttattactgaatcactacggcattaaaagaaatttttttgcgttacatgatcataatgaacaacaaaaagcagatgtactgattgagaaattacaacaagggttaaatatagcacttatttctgatgctggtacacctttaatcagtgatccggggtttcacgtggtgcgtaaatgtcaccaagcaaatatccgagtggtcccattacctggagcttgtgcggcaataaccgcattatgtgcatcaggcatcgcttccgatcgtttctgcttcgagggatttttacctgccaagagtaaggcaagacgagataaattggcaaacttagcaaatgaagaccgcactttgattttttatgagtcaacgcatcgtattttggattgcttgactgatattgaacttgaattgggagccgatcgctatgtagtgcttgcacgtgaaatcacaaagacttgggaaacaattcgaggagatcaagttggaaagttgcatcaatggctacaagaagatcctaatcgaacgaaaggagaaatggtgctaattgttgagggcaaatcaaaaagagaagatgaaacattttcccctcaagcgattaaaacattacaattggttagccaagaattacctttaaagaaagcagcatctattgttgctgaaatttatggctataagaaaaatgcactttaccaatttggtcttattcaaggttactaatataatgaggctataatctcaggtttaatttgggtataatcgccaaactttttaggtctgatttttaaggacaaatatgagtcaatttttttatgttcattcagaaaatccacaatccagactgattaatcaggcagtggagattttacgtcaaggcggcgtaattgtttatccgaccgattccggttatgcactaggttgtatgattggagataagcatgcaatggatcgtattgtgaaaattcgccaactacccgaagggcataattttaccttagtttgtagcgacctgtctgagttatcaacttattcagtagtgaataattcggtatatcgtttgattaaaaataatacaccgggtcgttatacttttattctaagtgcaacaaaagaattacctcgtcgtttaatgacatcaaaacgtaaaaccatcggtattcgtgttccggataatcaaattgcgttagatctattaaaatccttaggcgaaccaattttatcttgctctttaatgttgcccggagaagaatatacaacacaatccgatccggaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataaattaactttattcattcccattatcatagacgcttgtgaaagcgacagtaaggaaaataaatgaaagtaaataagcaaaaatcccgtccaactaaaccgcactttgcaaagcaggttaccaacgagtctatgcgagataatacgaagcgatttgcaaacaaagaaacagtatctgaacgtaaaagtgcggtaaaaaacactcaaatttctccaatatcaacaaaatcaactcatgctatcaatcagcaaaaagtcgaaggggaaagactacagaaagtgttggctagagtaggacaagggtcacgtcggacaattgaagcaatgattagtgccaatcgtattagtattgacggaaaaatggcgactttaggtgatcgtgttgatatacattccggcgtaaaaatcagaattgatggacatattgtcaatttaactcaagcacaaaaagaagtatgtcgcgttttactctattacaaaccggaaggagaactttgcactcgacatgatccagaaggaagagcaacggtttttgatcgtttaccccgtttaaacggatctcgttggattgcggttggtcgtttggatattaatacatccggactacttttatttacgactgatggtgagttagctaatcgtttaatgcacccacgacacgaagttgaacgcgaatatgccgtgcgtgtttttggggaagtagatgatacaatgattgctcgtttacgtaaaggcgttcaattagaagatggacctgctaactttaccagtattaaagcaacaggcgggcaaggaatgaaccaatggttcgatgtcaccttgatagaggggcgaaaccgagaagttcgtcgattgtgggaatcacaaggcattcaagtaagtcgtttaattcgtattcgctacggtaatattaaattaacgaaatcgttaccacgtggcggctgggaagaaatggatctaaccaatattaattatttacggaaacttgttgggctaccgcctgaaacagatagcaaaattgatactaaaaaacctcgtcgtataaaaacgggacaaattcgtaaagctgttaaacgctatactgaattgaataaacgttataagaaataaaaaacttaggggctgtattagattagtaagtatgctagtctataaaaatgaaaataactcattgtaaattaaagaaatctatacagaaaaagctccttgagttttttgtgttagaagtgacagctcgatcagcagctaatattttaggtatcaatccaaattcaagtgccttgttttatcgtaaaattcgtgaagtcatcagctatcatttagcccttgaagccgatgatgtttttgatggacagattgagcttgatgaaagctattttggtggtcatcgtaaaggaaaacgagggcgtggagcaaccggtaaagtggctgtttttggcttgttaaaacgacagggaaaggtatttacggtggtggtagaaaataccaaaaccgaaacgataatgcctgtaatcacaaggaaaatcaagcctgacagttgggtttataccgatacatatcgtagctatgatgctcttgatgtgagccaatttcaccacgaacgcatcaatcattcggagttgtttgcagtgaaagaaaatcacatcaacggtatagaaaacttttggagtcaagccaaacggatactccgaaaatataatggaattgaccgaaaaaactttcctttgttcttgaaggaatgtgaatttcggtttaactttggaacaccaaaagagcagttaaaaacattgcgaaaatggtgtggaatttagggctgatctaatacagccccaaaacttatttaaaagtgtgaattaactcacaaattttaaattacgtatttgcattatagaacatgattttttacattgcaccttataaaaagtgctataaaaaagtagccaacatattttgctttccgagtagtgcctcttttgaggcactttttttgtgtttgaataaaacaaaaaacctagcaattcaaaggttatcgctaggttagataaataaattagttaaacacgccgctgacgccgacacggaaaccaactcggcctctactatcagaagaaatgccgccggatatggcatattttccgtttgcggaagttctaccgaggtttaaagagaccgcactttcgctgctataacgagcggcaccggcggcataagaccatttacccgggacgaaaggcacatctttaaaagccatcgcggcggcgataccggctttagcgtctttattgacctcttcaacacgttggttagttgcgtgtaattgactaccgtttactgcgtcagttgagcgatgagaaagcaaaccggcggcaacattttgaatacggcgttcattgcctttgctgcccacggaaacgacgccttttgcatcaacgccggcgtaattgccgttgactttaccgataccgcccgttgtttcgcctttttctacataagcagaagaatcaccgaggaagacggagttatcaacctcaacattaatattattaccgataacggtagttttagttcctttgtttacaatactactaccaattgagaatgagcgttctttatgtgtttgtacatcgttaccaatacttaaagagcgatctccatacacttttgcttgaggaccgatggcttgtgatctaagtccagcagcatgtgaatcccaacctattgctgtagataattcattgatgcttttagatttataaccaaaagcattactataattgccagaagccgtagcaccttgtccaagagccgaagcaaatttcgcagttgctttcgcttcatcacctactgctactgcaaatttttcagttgctttagaatctttacctatagaaaccgcctgtacacctgcatttgcttggtagcccattgctacggcataagattgtgcctttgctgtcttaccaaccgcagttgctccttcatgtgcagcatttgcatcaaagcctacagcgacactagactcagctactttggcattttttccaacggcaacggatttggtatcatccttataccttccttctgccttagcaccttcaccaatataaatatgcccattactaacattaatattattactatttgattgttgagcttgagccatagccgaatgagcagttaaaacaactaccgcagttaaagataaataaaaaattttcacttaaaagaaacccttaaaaaaagagttaacatagaaaaatcataaaaaagctaaccgcactaagaggcgataatttatgacacgccttaaaaagaggtagtggttctaccaaagcgggcgaaattttaagcgggggggggtactgtcaataaaaaaatgaaaaaatgtgaaaaaagataaaaaaagtaaaaaatgaagataagaagcaaaaaagtgagaagtacaagtaaaaaaagtaaaaaaagcccgcactttttaacaaaaagtgcgggttggattgggaaattttgggttatgtagaaagcgagaagctatgatgatagttttggcttgtggcttataagtaacgtttaatccgttaagattttttttaccttttctttcatttggttgaactccaatgatattcattggagagtagttctgaaagttcattgaaagtgttttgcgtaaaaaagaggaatgctagtctcttaatttagcgggaggaattagtagaataatatccgcccatcgcactgtaaatcgcattttgactttgaattaaactgtatttcgcattcagaatggctaattgagaggcattttccatattagctgcattaagccattctattaattctgcgataccggcatcatagcggtttttgtaatattgcgtaatacgtttgttgtaacggtaagtctcttgtaaatttgcaacattttcttttgcttgggtataagagaaatagaggttgtctatttcatttagagctttggtgatgttttgttcaaaattcagttttgcattttcataagctgcctcagaaattttaacattccattttactgtattccaatttaagaaaggtaagtttatgcctaccgttcctgtcgcaatcggtatgttgaaagcattgtcaattttattaccgcttgatgataatcctgctcccagtgtgattgatggaaaccaacttttttgcattgctttcgcatttttaaatgcactattgaggcgatataaagagcctttaatatccggacgattggcaatggttgataatggaatatccaaatttacctctgcacttttgacttccaagatatgtggtgttttgatgtttaaatcttcattcggttttaagttaagcaaattacgcagggtagtttcggcacgttttttttgtgtttgataattaatcagattattacgagccttaagaattgattgttgtgattgatctgtacttgcccgatctgccataccttggttgaatttattttgcataattcgactaatttttgagtaataattaatcgtttggtttgttactgcaatggcatcatttaaataggcaagttgatagtaagttgtgacaactgagttgatcagagagagttttgttgcttgtaaatcttgttgcgtagcggaatgtgtccattttgcagcagaggttttatcggctaaacgttgccataaatctagggtgtagctaatattgagtgaaccgccgtgagtaattttagagttactccctgtgttaatatttttggcggctgaagaattaacgcctgtttggcgtgtgaaatttggtactaaatccgccgcaaccaaattggcattgtacagagccgtgtttactgcaatagtggctttggcaagatctttattattttccaaagcttgtttcaccagttggttaagcggttcgtcattatattgtgtccaccaattttcctgaatgttatattgttgagtcaatgcttcatattgctgaaaatcttgtaatgttgcatggtaactgtcatcaatatttgcacaaccgattaatatattagacaccactattgcaaacgtcattttagaaagttttaacataagttttccttatcttgtaagcagaaaagtgcggtctttttttccgcattttctgcaaattttatcatgcttttattcatgtgtcagagaggaaattgagtttaatttagatgcctttttgaaggtatatttactttaaaaaatggcttggtagttcctgatcacatacgattatgtcaaatttatctatcttatcaatataagctttttgaacttgatttatttttgatgaatcaattaccaaaatagcttgctcggttttctccattgctttttgttttgtttttacttcatcaaaattaaagcaagttacgcctttatttacatcaatccctgcagctgagatgaacgcttttgttgtgcaaattgcatccagttcattagttagctgaataggaattaaaaaagagttattctttgaataatttccaccgcacaaaatgacttcacaatgaggtttatcttgtaacaccataaaggtattaattgaacagcaaagtgcggtgaatttaatggcaggatcgatttgtgaggcgacgaaaggaattgttgaaccacagtcaaaaaaacacacatcgccgtctttaatgaaattagccgcaatgcgacccacttccattttttcggcaatatgctttgtttcttgttcaaaaatttggtagctgttatcggtgtttttttgtggatttttgacaatatagccaccaagtaaaacaactgagcctgtatctgaagccaaatcacggcgaattgtcatttccgatacatttaaaatagtggcagcatcacgcaagtgaattttatccatttgtttgagcaaaaagtctaatttttgaatacgtgattgtattttcttatccataacaggctctattaattaaaacggttaataaatagcgttattgtctgttaaaccgttaataatagcaatccctgaacttgatccaattcttgtcgcaccatttttaatcatttcaattgcggttttagtatcacgcacaccacctgaagctttgacaccgatattttctccaaccacttgacgcattagtgcgatattttcaaccgttgcaccgcctttattgaaaccggttgatgttttaacaaatccgacccccagttcacgacaaatcttacaagcagtgataatttcctctttggttaacaagcaagtttccaaaataactttaagtaaagcaccttcacaagcagctaaaacagcttgaatgtctgcttttacggattcccactgatttgatttaatccaaccaatgttaatcaccatgtctatttccgttgcaccggcttttattgcttctttagcttcaaaagcttttacagtagataaattagcacctaatggaaatccaactactgtgcatattttaacatttgtattttgtaatttttgtcttgctagcggaatataacctgaattaatacaaacagaaaagaaattatgttcaatcgcttcgttacaaagatctagtatatcctgttctgttttctccgcagttaatgctgtatggtcaatgaattgagcaatgtcataagattgcataaatatcctccttattttaggtttatgtgattattttcacttttttatatgatactgcaaaaaaaattaaaaactgtgactttgatcacttttttaacatttttaattttatatactgaataaaatgaattttgtgagaattataacatttattacggagaaaaacattatggatattgcagtcattggctcaaatatggtggatttaattagctatattaatgatatgccgaaaatgggtgaaacgctagaagctcatgattttaaaatgggttgtggcggaaagggagcaaatcaagctattgcagccgctaaattaggtgcatcagtaatgatgatgactaaggttggtgatgatgtatttgcagataatactattaataatttcaagcaatatggtgtgaataccgattttgtcgaaaaagtggtgggtgtatcgagtggtgtagcccctatttttgttgatcgttcttcacaaaatcgcattttaattattaaaggtgcgaattcttacttgaaaccggcagatattgatcatgctgaagttcagttgaaaaactgcaagctgcttattttacaactggaaattcctttagaaacagtttattacgcaattgattttgccaataaacatcaaattccagtcattcttaatcctgctcctgcaagtaaggaattagacattagttatgcttgtaaatgtgatttctttatgccgaatgaaactgaattggaaattctaaccggtatgccagttgacaatatggaacagattcaagcagcagctaatagcttatttttgaaaggattaaaaaatctgattgtgactttaggcgaaaaaggatcggtttggtttcatcgggatcaggtaacacatgtttcctcgcacaaagttaatgctattgatactagtggtgctggagatgctttcattggttgttttgcacatttttatatacaaactaatgatgtcaaacaagcaatgcaaatggcatcagcctattcagcctatagtgtaaccggacaaggtacgcaatcttcttatccggataaagcacaattcgaacaatttctacaatcgttaaaataaggagtatggtatgaaaaatattcaacaaatgcccgatggttatctcaataaaacacctattttccaatttattttgctttcttgtttattcccactttggggagcagcagccagcttaaatgatattttaatcactcagtttaaaagtgtatttacgctgagtgattttgccagtgctttagtacaaagtgcattttatggaggatattttttaattgcgatacctgcatcattggtgatcaaaaaaaccagctataaaattgctattttaattggcttaatgctatatatcggtggttgttcactgttctatccagcctcgcatatggcaacatacacaatgtttttagtggctattttctctattgcgattgggttaagtttcttggaaacctctgcgaatacttatagttcaatgattggacataaagatcatgcaacattgagattaaatataagccagactttctatccagttggtgctatttcaggtattttattaggtaaatacctcatcttccaagaaggtgccagtcttgaagaacgaatggtaggaatgacaccggaacagttgcattcatttaaattatcaatgttagaacatacgttatcgccatataaatacttaatcttcatattgattgcggttacttttttattcgtaattacctcttttcctaaatgtaaagcagttacacaaacaggtaaatcagaagtgaaatttaccgatacgctaaaatatctagcaagtaatacaaaatttaaaaagggaattgttgctcaatttctctacgttggtatgcaagttgccgtatggtcatttactattcgtttggcactcaatttaagtgatatgaatgaacgtgaagcctcaaattttatgatttatagctttattggattctttattggcaaatttgtcgctaatttcttaatgactaaatttaagtcagatctcgttttactttggtattccattttaggtgtgatcactctagcttatacctcttttgttcatgatttttctgctgtttatgcggctattttcgccagtttgttgtttggtccttgctgggcaacaatctatgcctccgtactggatactgttaagcaagagcatagagaagtgggtggggctgttgtcgtcatgtctattatcggtgcagctgttgttcccgcaattcacggttatgtctcagatacattaggatctctccaacttgcatttattgtacctttattctgttttgcttatgttggctattatttttatggaaaattaaaagaaaacaaggagaaatagtatgaaaagctacctttatttatctaaatcacaatttacagataaagaacaacttatttttaaaaatgaaaagctaagtgcggtcgcatttcaatatcaatccggtattgaggcggtcaaactgatcaatagtaaaggttttctaattgttttacctttttatgggcaaatcatttgggacgttcaatttaacggacaaactctcacaatgaaaaatatgttcaacgaacctaagcggggaacaactattattgatacctacgggtgttttgctttccattcaggcttaattcgtaatggttgcccaagtccaaaagacgagcatcctttgcatggtgaaatgccttgtgccgtaatggataaggcttggttgattattgaagatgacaaattagggattggtggtgaagttgaatatgtgaaaggtttcggtgagcattattcagctagaccggaggtgatattatctgctgacagtacattatttaatatcaatatggcagtgacaaaccttgccagtgttgatatgccgttacagtatatgtgtcatatgaattattgctatgaacatggtgcaacattcagccaaaatatccctgaaagtgcggtgcaattacgccaaactattccggctcatgtgaaaccgacaccgcaatggctatcgtttaatgaggagattaagaaagggaattatacactgtcatcgttggaaaatgatgaaatgtataatccggagatagtgttttttatggataatttgcaacaatatcagtcacaacttgaatatcgtatgcactccccgaaaggtcataattatttggtaaaattctcgtcagcacaattcaattatgcaacacgctggattttatataatgccgatcagcaagtgggtgcttttgtcttacctgcaacctgtcgtccggaaggatttttggcagctcaaaataatggctcattaattatgctaaaaccaaaagaaatgcggtattttagtgtcataacaggtattgaataacatatagcgaacaacataaatacggttgacaaaagtttaacggcattgctaaatgtatatttagttaaaatatcctaatgaaatgtttaaaaaaattggcttttataaaaatctcttgtataatcgccggaccctgtgaatgtgtcggatttcccaccgcacattattttatcaagatcacactcgaaggggtggagattaagattgatggttgtgcttaagtttaataagcactgggtattaatattattttattggtaattaattaatgaaaacttttgtagcaaaaccggaaacggttaaacgtgactggtatgtagtggatgcgacaggtaaaactttaggtcgcttagcggctgagttagctcgtcgccttcgtggtaaacataaagctgagtatactccgcatgttgatacgggtgattatatcgttgttatcaatgcagaaaaagttgcagtaacaggtaataaagaaactgataaactttactactggcatactggctatgtaggtggtattaaacaagcgactttcaaagaaatgattgcacgccgtccggaagcagtgattgaaattgcagttaagggtatgttgccaaagggtccgttaggtcgagcaatgttccgtaaattaaaagtgtatgcaggttcagaacataaccatgcagcacaacaaccacaagttctagatatttaatcacgaggttaggaaaatggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatacgtcacagttaaaggtggtggtatttccggtcaagcgggtgcaattcgccatggtataactcgtgcattaattgagtatgatgaaacactacgtcctgcattgcgtgcggctggttttgttactcgtgatgctcgccgtgttgaacgtaagaaaatcggcttacacaaagcacgtcgccgtccacaatactcaaaacgttaatttcatatacaaaattgcaagccaaatggcttgcaattttttttcttattttgtcggtaaattatgattgaggcttatgcattgccttttcatttatggtagaatggaaagtctttattaattttcaagtcgtcggaggaaaagatgacaagcgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggttgatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttggccagtcactttattttatgagcgaagaattcagtttagttgattgctatattgcgccgttattatggcgaatgcagcaacttggtgttgtatttacaggcacaggcagtaaagcgattaaatcttatatggagcgagtgtttcaacgtgattcatttttacaatctgttggtgaaatgacacctaaaaatttaatggaggataaataggattaatatgtcgtataaatttttacctaaacgtccctatttattaagagcctattatgattggttgattgataacgacttaactccttatcttgttgtaaatgcaacttattcaggtgtaaaggttcctgttgagtatgtcaaagatggtcaaattgttttgaatttatctgcaaatgcgacaggtaatttattgctgaataatgaggcaattcagtttagtgctcgttttcagggggtatctagagatatttatattcctatgggagcggcattagctatttatgcacgagaaaatggcgatggagtcatgtttgaaccggaagcattttatgatgaattaaatattgacagtgttgatgaacagcctttaggttttgctgaagcagttgatcaaaagaaagtgaaaaaaactgaaacaaaaacacagaaaggaacatcacatttgcgtattgtgaaataaactaaagcaattttttgaaccgcacttaaagtgcggtttttttatgaaaagtaatttaatcaattcttgtagttagaaatttgcattacgaggtgtgcgagggaatggaattacgtcacgaatattttgcacgcctgtaacataaacaattaaacgctcaaaacctaatccaaaacctgcatgtggaactgttccataacgtcgtaaatcacgataccaccaataatcttcagcttttagtcccatttctgctatgcgtttgtcaagcacttctaaacgttcttcgcgttgagaaccgccgataatttcaccaattccgggggccagaacatccattgcagcgactgttttaccatcatcattcaaacgcatatagaaagcttttatatctttaggatagtttttaactacaaccggcgatttgaagtattcttcggctaaataacgctcatgctcagaagataaatcaattccccaagatacaggaaattcaaacgctttaccggattttaacagaatatcaatcgcatcagtatagtctatttgagcaaagtctgaattgatgaaatcttttaagcgagtaattacatttttatcaacatgcttttcaaagaattttaagtcatcttcacgttcatttaataccgcacggaaaacatatttcagcatatcttctgctaattttgcattgtcagctaaagttgcaaaagcaatctcaggttcaaccatccaaaattcagctaaatgacgcgttgtatttgaattttctgcacggaatgtcggaccaaaagtatagattttgcttaatgcacaagcataactttcaccatttaattggcccgataccgttagaaaagactctttaccaaaaaaatcttggctaaaatcaaccgcacctttatctgtgcgaggcagattttctaggtccaaagttgatacacggaacatctcaccggcaccttcagtatcagaagctgtgatcaatggtgttgctacccagtagaaaccttgttcatggaaaaaacgatgaatagcttgagctaagcaatgacgaacacgagctactgcaccaatgatattagtgcgtggacgcaagtgtgccacttcacgtaaatattcgatactatggcgttttgcagacattggataagtttcaggatcatcaacccaaccggaaacttcaattttatcggcttgtaattcaacagcttgtccttcagcaggagactcgacaatttttccagtgacaacaacggaacaaccggtagttaaacgtaaaatttccgtttcatagttctcaatatcattatttacaatagcttggataggatcaaagcaagaaccatcgtaaatagctaagaaagatagtcctgctttagaatcccgacgagtgcgaatccaaccacgtactgttacagtttcaccgaccgtgatttttccttttagaatattagccacagatgcaatttttgtcatataaacctcaaatcagtttttataattgtaaaaattagtcattttaccgtaactcattaaaattaccaaaatgtatcggaactttttgtttttgtgagatagcacacataatttatataagtcccttgtttattaggaaaatttcttggtataaatgaacaattttatgaattaaaataatcaggtagaacaggtagaaaatatggcaaaagtgagaaaagaggataaattacctctgagaatgaagcagctaggcaaaatttatcgcttaattgaacaatttgaagaaatttcacgtattgatttatccaagttatctcaactggctcctgcaactatcacctccttaactagagaacttatagaaaaaaaattggtgattgaaagagcggtacaaaatacggaaaatcgtggtcgtccagcagttggattatgtgtctcaccattttactggcaatctctttgtgcaacactgacatacgatcattttgatattttgctatgtgagctggatggcacaacaatagcccaagaagtttatcctcttgatctttctgatttatcttcattagaacaaatgttgccttgctattttgaggattttttatcaaaagttgggactaaattgagtcgtccgattactttttctattgcagtggcgggtaaactacaccatttgtctggttttctgcaacgtttgggggagatcgaattaaatgtggatctaacatctttatttgcaggctattttgatataccgattattgtaacggaatattttgaaacttggttattagcggaaagcacattaggaagcgtaataggatatgatgatgtgattttcttgcaaattgatgaagtcattaatttgagtgttttatcaaaagggggtattctacagagtgatcataaaacttgtatgaatattgaccaaattattgttcctcgcctttatccaatgcaagataagatcaatcaacatttatttgagcttgagcgatatcaaatacataatcaattgacttataaagcattttgtcaatttatagatctgtattatccaaataataatttaattaacacgacagaaaagatcaattttttatgtaaaaaagcacagcttaaagatcctttagcattagaaattttagctaacatagccgatattattgcatacatcttatccaatttagttaatcttttttcacctgagaaaattatgtttacttctcgtttgctatccgtcaaacatgttttccttaatcaaataaatcagcgtttagcacattatttgcataattcaaaaatatgtgaagtaatgacgagccagtatgaatggaatagtcatgaagttattgctgctgctattaaacaaaagatttatgatggtagtttgttagtttatatggaaaaatattaaaattttcttcacttagctgtcaaaaaggcgttagaaagcatttttgattgcttgactataaataaaggtttcagctgaaagtatcatagcaagacttttaacttttaagagttaaaggcttttggggtagcgaatttacgcccccagctcttttgaaatggattgtgctgtttgtttgagatgcatgagcaatatatctttgccgatttggtttaaacgtgcagttgatagagaaattgatacggagtagattacattgctattgatgtcaaatatcgggcaagctaaacaagttacgcctgtttcattttcttcattatctacggcataccctaattctcgaatcttatttaactccagctccatagcactcagtgttacaattgtattagctgttaattttgtaatattcgtttgatttttctcccaataatcatctagaatgtgtctcttttcgtatgccataaaaatttttcccatagctgaacaataaagttctaaacgctgaccaatatacgctcgtgtacgcatcatacctgttgttggttcaagtttataaatcattacagcatgatgatgatcacgcatagataaattgactgtttcacctgtattcaaattaagttgctctaagtaaggggatgtaatatttaatatattaagtgaactcaaggttttttgcccaatcgttaaacacttcattgttaaacgatatgtaccaattgtattggtaggtttgacataaccacaggtttgtagtgtttgtagcatacgatatgttgtacttttatttagattagataattcagatagtttagctaatggacaaccattagggaaattgctcaaaatatcaattagtaataaacccttaattaaactttggttgctgctagcttgtttatttttattctcttctttcattttttattcctaaatagcttttttggttagttttattttagtgatatatcgataaaataaaaatgagatcttgatcacaaaaaataaaaaaatttatatctatatgatttataaaaacttttatttcttattttcatttgcatacaaattttattcagactataattttttaaaatatcgtttcaatatatgaaataaagattggcgtaatgaggttaaaacatgaaagtcagctacgaaatactcaaacaagaatttaaacgtatattacttgcaagaaatgttcgtgaagacattgctgaagaatgtgcgactatatttgcagatacaactgagtcaggagtatattctcatggggtgaaccggtttcctcgttttatttctcaactggaaaaaggagatattgtaccggaagcgattccgactaaagttctttctttaggtgcgattgaacaatgggatgctcatcaagcgattggtaatatcacggcaaaaaaaatgatggatcgagccatggaaattgcggatcaatttggcattggcgttgtagctcttaaaaatgcaaaccattggatgcgaggcggtggctacggttggcaagcagctgaaaaaggttatataggaatttgctggactaattcaattgcagtcatgccgccatggggagcaaaagaatgtcgtattggcactaatccattgattattgctgtaccgaccaaccctataacaatggttgatatgtcttgttctatgtattcttacggtatgttagaagttcatcgtttagcgggtcaacaaacatttgttgatgccggatttgatgatgaaggtaatttaactcgtgatcccggtactgttgaaaaaaatcgtcgcttattacctatgggattttggaaaggatcaggtttatctattgttctagatatgattgcaaccatactatctaatggtttatctgttgcagaagttaccgaagaaaaagatgatgaatattgtgtttcacaaatcttcattgctattgaagtagatcgtttaattgatggtaaaacaaaagatgagaaacttaataaaatcatggactatgtgaaaacagctgaacgagtagatgctgatgttgcaatacgcctaccgggtcataaatttgcggcagttcgtgctgaaaataaaattcatggtattccggtcgatgattctgtttgggaaaaaattaaatccctataacctataaggaatacttgttctctggtcattgttttgatcaataatcaactaaacccgtaaagttgttattaaaattacggtaaatgtgaattagaggtagcatgatgagatcgattagtttaaccgtaactaaactattagaagcattggttgttattattttagcaacgatgtcttgcttggtattccttaatgtcgtactacgctatggctttaatagcagtatcaatattacagaagaagtttcacgctacttatttgtttggttggcatttcttggtgctatcttagcctttaacgaaaatcgtcatgttaatgttacgatttttatcgagcgtttatctcagcatcagcgaaattttctacgcttattaacggacagcctaatgttgttttgctgttatcttttaattacaggtggctggatacaatttcagcttaatctaactaatatggcacctatttctggtatcccaacaggtattacttatttagctagttttattacaggcttagttattgccatactacttatcattcgacttttttctaatgctggtgctttgataaaaggagaaaacaaatgacggttattatctttctttccactttattaggaggtattttattaggtattcctgtcgccttttctctgttattgtgcggtatagcattaatgttgtatttagacttatttgatgcacaaattttggcacaacaaatcgtgagtggtgcagatagtttttctttaatggcaattccattctttatcttagctggtgaaattatgaatgaagggggattatcaaaacggattattgatttgccgatgaaattagtaggacataaatgtggaggattaggttttgttgcaattcttgcagcgatgattatggcgagtttgtcaggttcggctgttgcggataccgctgcggtggcagcgatgctattacctatgatgaaaacaacaggttatccgctggatcgttcggctggtttgattggtacggctggtattattgcacctattatcccgccttctattccgtttattatctttggagtctctagtggtgtgtctattactaagctgtttctagcgggaattgtaccgggaatcctaatgggaatttgtttagctgccctatggtggtggcaagcaaagcaccttcgcttaatgactttttccaaggcaagaaaagaagaactttgtgcttcctttaaaaatagtatttgggcattaatgttacctgtaatcattattggtggtttccgttctggtatttttaccccaacagaagcaggtgctgttgcagcattttatgcattatttgtcgcactctttgtatataaggaattgaaaatcaagcaactttatcaagtttttctcgcagcggcaaaaacaactgcggtagttatgtttctcgttgctgctgctcaagttacaggttggttaatcacgattgctgaattaccacatatgatgacagcattgttagagccactaattgatacaccaactttattacttattgtcgtaatgctatttgtttttttgattggtatggtgatggatcttacgcctactgtattaattctcacaccggtattaatgccattggttgaggaagcaggaattaaccctatctattttggtgtgctctttattttgaatacttcaattggtttaattacgccaccggtaggtaatgtccttaatgtcattacaggtgtatctaaattgccatttgatcaagtgacaaagggcatacttccttatttattgatgatgattgtgttgctctttatctttattttcttccctgctttaattttaatgccacttaattggttacaactttaaatcttcataggagaacattatgacactattaaattttaaaacgctttctgtgttcatggctagcatgactatattctcaggcactgccagtgctgcaacaacattacgttttggttatgaagctcctcgtggtgatacacaacatgaagcagcaaagaaatttaacgaccttttaaaggaaaaaacaaaaggagaaatcaagctaacactttttccagacagtacgttaggtaacgcacaaactatgatcagtgctgtacgtggtggaacgattgacttggaaatgtcaggttctccaaatttttctggattagtaccaaaattaaatgtgattgatattccattcattttccaaaaccgcgagcatgtatatgccgtattggatagtgaaattggtcaaagtttattaaaagaattagaagccaaaggattaaaaggtttagctttttgggaagtaggatttcgatcttttactaactcaaaacatcctgtaaaatcccctgatgatattaaagggttaaaagtgcggactaaccaaaatccaatgtatattcaagcattttcaatcttaggggcaaatccagttccaatgccattatccgaactttataccgcacttgaaacacgtgcggtagatgctcaagaacatcctgttggtattgtttggtctgctaaattatatgaggtgcaaaaatacttaagcttaactaaccatggttatacgccattgattgttgttatgaacaaagccaaattcgatgccttgtctccggcattgcaaacagcattagtcgaagctgcacaagaagcaggtgcttatcaacgccagcttaaccttagaaatgaaaaaagcattattgaaaaaatgcaaaaagcgggcgttgaaattattgagcgtgttgataccggaccgtttagggcagccattgaaaacgaagtacgcaaggcattcattgagaaaaatggtgatgatttagttaaaaaaattgatgcattagcaaaataagtatattcaatgataagaaacagaatttttattaaattgaccgcacttttacttattccttattcggaaggaggagcttatgttggcaaatggagacgttccaatccttcagctacagcatatcgtcaaacgattcggtaatcaggtagcagtaaatgatgttagccttaatattcaccaaggagaaattgttgcattgctcggtgagaatggtgcgggcaaatccactttaattaaaattctggcaggtatctattctcgtgatgaaggtgaaatttattttcatcaacaaaaaatccaatcggcacaatctcttaccaataaaaataaacaacctattgcttttattcatcaagatttagggctggttgaatggatgacgattgctgaaaatatggcatttgtaatgggatttcctcgccgtttcggcttgattgattggaaaaaaattaatcaacaagcacaagaagcattggattttgttggtattcacctttctgctcaaactcgagtttttgacttaagtcgtacagaaaaagcgttattgaccattgctcgtgcgattgctgtcaatgctgagattttagtgttggatgaaccaactgcctctctacctgcaggtgatgttgaacatttattcaaggtgcttaatcgcctacgtaaacagggcgttggtatgatttatgtcactcaccgattggatgaggtcattaggctttctgatcgcattttagtcatgcgtgatggttattctgtggcagaaggttcgactaaagattatgatgtgaaagctctagtgaaggctattgttggtgaagaaacaagagaaaaacaacgtgaaccattgcctaaaaacacaccagaagtggtacggcttaacgaagttgttgttggtgataccggtcctgtttcctttagtttacatcagggcgaaatgattgcattagcaggattgcgaggtgcgggacaagaagagataggacgattattatttggactacgtaagttggaaagtggagacattagtttaaatgaatgtgcttatcatgccgagtcgccatgtgaggcaatttataaaggtgtagcacttgttgccggagaccgtatccgagaaggtcttgtcatgtcaatgacaaccatggaaaatctctttatcaatcctatcttaagtggtcattttccattaaaaaattatgcaagcaaaaaagaaaggtctgaatgttggtatcaattccagctctttgatattcggccaaaaaatttatttattgaggtcagttcgctttcaggaggtaatcaacagaaaattgtgcttgcacgttggatgcagctcaatacacctgtgctgattttagaagatccaactgcgggtgtagacgttggtgcacgagcagaaatttatgacttattaaatcaagccttgaaaaaaggtgttgcaattattgtgatttcaaacgattttgaagaaattgcacatctttgtaatcgagccttggtattcaaccgaggcgatatcgtgggtgaattattcaatgaacaagtcacatttgcgaatttgctggcactcgcttcggacgcatctgctaccataaattaattttcgtgtttttagaccgcacttaaacaataggagagcatcatggctcaaacaaatattaaatcaaccgctttagaacagcctgtatctattgcacgtgatgggttttgggcgtgggtttctcaaatgatcactcgatatgggttactctgcttatgttttttacttatcatacttttctctatgacaacagattcttttgcctctatgctaaccttacatgcgattttagaaagtaaatcaaaaattgcactattggcactcgcagcgacgacgaccatgattgtaggcaaaattgacttaaatgtaggctttggtattgttctttggcatattttagctattacactacaagttcaattcggtttttcatggcaaatggcgactatcacagtactcattgtggcagcaatttatggcttacttaatgggattttagttgcacttgctgacattgatagcttcgtcgctacattgggaacgggaacggtattgtatgcaattgctttatggcattcaggcggtcgccaaattgtcggtgatttacctgatgcttttattgctattaacagtactgagatcttaggtattcctatctcggctttttatgtgttaatcgttgctattgtcatgtggctggtgactgaacataccccaacaggacgttgtatgtatgctgtaggaggaaatcctaccgccgcttatttgaatggtatttcgattaagaaatatacgattgtgccatttattgtatctagtttaatcacagggtttaccggagttctcatcgcagcacaacagggtgttgggcaagcaagtgtcggaatggattatcttttacccgcactggtaggtgcgttcttaggcagcactacaattaaaccgggtcggattaatgtttggggtaccgttattgggattgcaattcttgctattggcatttctggtattcaacaattcggcggtgctttttgggtcgagccattatttaatggtgcaactttattattatctatcactatcgcaggttatgcacaacgtaaacgtttattaggtcaaaaagcagtacacaagaaagcagcaacaaaataatttgttgtgttaattacccattaaaaggagaaaatttatgaaacagttttttcattgtagtttaagtgtagtggcttctgtagtcgcactctcttttgccggcaacactatggcaaatgatccatttgtcgctgaagcaaaacaacaagttgctacagctgctgctcaaaaaacaacttgggatggaccaacaacaggtccaaaagtacaacaaggaaaaaatattattttcattgcttctgatatgaaaaatggcggtgtattaggtgtaattgatggtatgaaagaggcaacgagtatagctggctggaaattagatattcttgatggagcaggtgcggtcaataatcaactttctgctttaaaccaagcgattgctcgtaaacctgatgccattgtcattgggggttggaatccaaatgtggcaaaaattccacttagcaaggcaactaaaaatggaatcacattggttgcatggcatgctacaccggaaccgggaccaattaataaatataatattttctataatgtcacctctgattctgaccaaattgctaaactttcagctcaacttgctgtagcaaactcagatggaaaagcaaaagtggttattcttaccgattcactatatgaaattgcgttacgtaaagcgaatgtgatgaaagaaattattgaacaatgtaaagaatgtcaggtattagagttcattgatacgccgcttgcagatacctcaagtcgtatgccgagcctaacttttagtttattacaaaaatatggtgataacttacaatacacacttgctattaacgatctctattttgattttatgacaccgtccttacgttctgcaaacaaaggagaaatgccatacaacatttctgcaggagatggttcagttactgcctatcaacgtattcggaataataatcatcaatttgctaccgtaccggaacccctgaatttacatggttggcaattagtggatgaacttaatcgtgcttttgctggagaaaaaccctctggttatgtcactcctgctcacctagtgattaaagacaacgtggcatttgatggtgggaataagaacctttatgatccacaaaatggttataaagaagcctataaggcgatttggaacgtgaagtaatcaactattgtggtcgcaaaaaattgtcaaaaaagaccgcactttcctagtaaggagagtatatgttatcagctaaaattgaagtttatgattcacgcttttaccaattagttggcactgaagctagattagaagaattgtttgacaaagcgatttgggcagagggacctgtttggctagaaaaacagcaagctgttatatttagtgatgtcaaaggtaatacaatgtatcgctggacggctgaacaaggtacacaaatattccgacaaccatcacaatttgccaatggtaatgcagtggatgctgcaggtaatttgattacttgtgaacacggtcgtcgagctattagcttaacggatcatgcaggtaatattcgagtgttggtcaataaattagaaggtaagcgactaaattcacctaatgatgtagttgtgaaatctgatggaacaatttggtttacagatccaccttacggtattttaagtgatgcagagggcaaaaaatcgcctagtgaaataattggctgttatgtatattgctatgatcctataactgacgatatccatatcgcaacttttaatgtcatgcgaccaaatggtttagctttctgtgaaaatgaaactaagctagtggtagcagatatgtcggtagtcgagtttaaaagaacaggcttacaccatcttgtagtgtttgatgttattgataatcagttatataaccgtacaagcattgctgctatttcgccaggtattcctgatggattctgtattgatcacaataatgtgatttattgtagctgtgaaacaggactgctggttttgttacttgatgggacttttttaggaagaattttactagataaaaccgcttctaattgtacctttggtttagatcaaaaaaccttgtttattacagctactaatagtttgtattgtttaacctttaaataaaaagagctggtaaggattatagaaaataatctttaccggcttttagctttatatatttattgaggattaataattttgtttagctttagcctggtcaaccactacaggatcaatataataaacctcggggatatcttgcttattaatttgtttaattgcatgttcaattgcgacagcaacttgttttttcggtaattgatcaattgtattttgcattttgccttgtttaacgtattcaatagcgagaggaataccatcatagccagttataagcactttgcctgctaatcctgcattttcaaccgcagtaactgcacctattgccatattatcatttgcggcaaaaataccttgaatgttagggttggcagttaagatgttagtggttacatttaaagcctgttctgtttcccagttcgcagattgtgaagcaacaattttgatatcaggatattcagagaatgcttttaaagctccggctttacgttgttctccattatcgacaccaggaatcccctcaagtatggcaatatttccttttttacctatcgcttctgcaaggtttttagcttctaaataacccccactaaaattatctacgccaacatagttaaattttaatccagcttttttagctgcttctgcatcaagtcttacatctaaatcaataattggaatccctgctttttgggccttttggaaagcagggataaaggcaatagaatcatttggtgtaacaataattgcatctactttttttgcgatcatattttcaactaatccaacaagttgttcagttgagtcttctttttccgcaacttgaattgtcaaatctacatttagttgtttagcagtttctttagcaccctgttgcatagaaatgaaatattcattgcttagtgttttcattaataatgcaatttgaggtttttctgctgcaaaaagagaggtagaaatagccaatgtacttgttataagcattgctttgaatagtttagatttcataattgatctccagtgagtttgtagttaaaaattggtagcaatcctaaaataaaacttgtctaaaaactgtgatctagttctcaaaataaataaaactttaaaagtctattttctcagcttttaagtttatttactttgtgtgatacctatcacgattttattagtctttttatgttattcttaatatacagattgataaaaagggataattgctgtgttagatactttacctattttgtcacttagaaatattagtaaaaatttctatgacgtagcggttttagacaaaattaatcttgatatatattcaggcgaagtgcattgtttaattggagaaaatggagcaggaaaatctacgttatgcaagattatcgctggcatctataattcagatggtggcgaaatgttttttcatggtaaaatttattctcctcgtaatgtaaaagacggtcaaaaatatggagttggttttattcatcaggaactaatgctagtacctcaacttactgtactggaaaatatttttttaggaaaagaacatgcgaatttaggaaatcgcatggactggaaaataatgagagagaaaacactaaaaattattcgtgaattagaactcgatatacagccggatgatttagtatcagatctttcgattgcacaacaacaaatggttgaaattgctaaagctatttttagtgaatataaagtattaatttttgatgaacctacttcttctatatctcgtaaaaatacagaaactctttttagaattattcaccggttaaaagaaaaaggtgtagcgatgatttatatttctcaccgtttagaagagtttcaatatatttcagataaagttacagtattacgagacggaaatattactggcacgatgttgtataaagaaacatctgtagaagaaattgtcagattgatggttggtcgagaaattaatttaggacattatcaaagagatacaatatttacacaggaaaaattatgtgttgaaaatattactaataaaaaaattaaatcagcttcttttactgtgcataaaggagaaatattaggatttgcaggtttggttggagcaggtagaacagaacttttaagagcaatttatggagcagatgatgctaaaggaaatatttttatagataagttaaaagtttgcattagatcaccggaacaagccgtaaaacataaaattggatttattacagaggatcgtaaactacaaggtctcatattagatcagagtattcggaagaatataacattaccaatattaaatcgtttctggacaggaattagattagatcaagaaaaagaaaaaaatgtagcagagagccaacgtgatcgcttgagaatcgtgtctaacagtggtgaacagcacactagaactctttcaggaggaaatcagcaaaaggttgtaattgctcgatggttagaaagtggtgtggatattttattttttgatgagcctacaagaggaattgatgttggtgctaaatctgagatttatgacttgatgagagaatttacagacaacggcggtactatcattatggtatcgtctgatttacctgaattaatcacaatgtcagatagggtaatggtcatgaggaatggtgaaattgtagaagaagttaaagatcgttctagaattactgaagaaaacctaatgaaagctatggttggtgtatgaggtctaaaatggataacttaaaattaattttttcaaaattaggaattggtattgcattaattgtaatgattattggaatgtcatttgcatctgatgcatttttatcagctcataatattctaaatattttattacaagtttcagttatatgtattattgctgtaggtatgacttatgttattttaactggagggatagatctttctgtaggttctatcgttgcactaagtgccgtatgcttaggattatttactcatctaggtcttaagtggttaggcgatgaagtatcagattttgccgtattagcggtggttttaattgctatattagggagcgttttagttggtgcactatgtggatatataaatggaattatcattgtgtatggtaaagttacttcatttattgcaacacttggtatgatggggattgctaggggattggcactaacgatatcagatggaaaaacaatttataactttcctgatgctctgcgtttttttggtaatggaagaatacctatttcagattcgttttctatacctatcccagtaatcattgctattttggttgtgttggttagtttttatgtgctaacgcaaacgatttttggtcgccaaatttatgctttaggtggaaatcgagaggcggttcgtttgtctggtgtaaatgttgagaaattagaagtcaaaacatatgtaattaatggggcattggctgcagtaggtgcggtaattttagtaggacgtttgaatgcggcacaacctatcgcaggtacaggttatgaattagatgctattgctgcaactgttattggtggtacaagtttgatgggtggttttggttcagttattggaacttcaatcggtgcattaattatgggagtactgcaaaatggtctgactttattagatgtgacgtcttatttacaacgcctaattattggtgttgttattattctagcagtattttttgaccaattacggcgtggtaaagtttcaataggacaattaaagcgtattttctttagagaataacttagaagatagtctaaatagttaataattttaattattggtatgcacagttatttgaataaatatattgcttgctgaaatttaggataaggaatagtgaaatgaattacacacttggtattgactgtggaggcacttttatcaaggctgcactctttgatacttttggaaaaatgattggttgcgtgcgtgaaaatgttgatgtgattagcgagcaagccggctatgccgaacgtgatatgtatgaattatggcaagtttgtgcaagtgtgattcgtaagacaattgaacatagccaaattgaacctagtaatatcaaaggtgtgggcatttctgcacaaggtaaaggtgcttttttattagataagaatcatcgacctcttgggcgtgcgattttatcttccgatcaacgttcacttgatatcgtgaaacaatggcaagctgatggtattcctgaacaactttatccaataactcgccagactttatggacaggtcatcccgtctcaattttgcgttgggtaaaagaacaccagccaaaacgttatgaggaaataggtgcggtattaatgtctcacgattatttgcgtttttgcttaacaggaaagcttttttgtgaagaaacaaatatttctgaatctaacttatataatatacttacaaggcaatatgatcctgccttggctgatttactaggtttatcaggcattattgataaacttccgcctattattgagtccaatcaaattgcaggctatatcacgcctgaagcggctactttaactggtttatgtgttggtacagttgtggttggcggattatttgatgttgtttcaaccgcactttgtgcagatttggatgatgaaactaaacttaatgctgtattaggcacttggtcagtgataagtgggatcactgatggtattgacgataatcaaacacttccttttgtttatggacgctatgcacaatctgagaaattaattattcatgaagccagtccaacttcagcaggtaatttagaatggtttgtgaagcaatggcagcttgattatcaacaaattaatcaacttatcggggagcttgaacctgctaccagttcagttttatttgttccatttttgtatggttcaaatgcaggattaggtatgcaagctggcttttatggtctccaagcacatcatacacaagctcatttattgcaagcaatttatgaaggagtactatttagtttaatgcatcatcttaatcggatgttacaacgctttccaaatgtgaagttattacgtgttacaggtggtccgacaaaatctaaaatctggttacagatgcttgctgatctcacaggaatgaaactggaagtaccacaaattgaagaaacgggatgttttggagctgcattgatggcgaagcagggttctagtgagtcaaccactgatgttttccaaacgcaaactatgttcagtgttgagcctaatcctatttatttcacagcatatcaaagaaaatatcaacgttatcaaaaacttatagattcgttaaaagcaatgatttaatgaggaaaaaatgacaaagccacttattcaacttgcactagatgaaacagatttaaacaccgcacttgttactgctaagcaagtagcagactcggttgatgttattgaagtaggcactattcttgcttttgcagaaggtatgggagcagtacgtatgttacgagcacgatatccaaagcatattttagtttgcgatatgaaaacaacagatgcgggtggtattttagctgaaatggcatttaacgcaggtgctgactggattactgtttctgctgcagctcatattgcaacaattgagagttgtaagaaaatagctgattactatcaaaaagaaattcaaatcgaaatctatggcaattggacattcgatgatgctcaagcttgggtcgatttaggtatcaatcaggctatttatcaccgtgcacgtgatgcggaaatagcaggtaaaggctggacggaagatgacttagtaacaatgaaaaaattatcaaaaatgggattatcgctctcaattacaggtggaattgtgcctgaaaatatctatttatttaaagatatcaatgctaaagcatttattgccggacgggcttttacaggtgaaaaaggaaaatttactgtagaaaaaatgcggttagaaattgataaatattggtcctaatattgcagagataaacatggagtatattgtgagaacacataaaatcggtatttatgagaaagcattacctaagaacctaagttggcaagaccgtttatccattgcaaaagcatgtggctttgattttgtcgaaatctcaatagatgaaacagatgaacgtttagcacgattagattggagtaaagctgagcgtattgaattagtaactgctattatttcaacgggcattactatcccatctatgtgcttatcaggccatcgtcgctttccatttggtagccgggatgaagcaactcgccaaaaagcctttgagatcatgaaaaaagcaattcagcttgctgttgatcttggtattcgaactattcaattagctggttatgatgtgtactatgaagaacaagatgaaggaacaattcaacgcttccagcagggattggaatgggctgttaaacttgcggcaagtcaccaagttaccattgctgttgaaattatggatacacaatttattagctcaatcagtcgttggaaaaagtgggataatataatccgctcaccgtggttcacagtttatcccgatttaggtaatctttctgcttggaatgaaaatgtgagtgaagaactcaaattaggcattgataaaatatcagcaatccacttaaaagatacttataaagtgacaactactagcaaagggcaattccgtgatgtacctttcggtgcgggctgtgtagattttgtacaatgttttcgtaccttatctgaattaaattatcgtggtgcatttttagttgaaatgtggacagaaaaagcagaagaaccaatcacagaaattattaatgcacgtcgttggattgaacaaaaaatgaaagagggtggttttcaatgttagaacaattaaagcaaaaagtatttgaagcaaatttagcgttacctaaatatcatttagtgacatttacttggggtaatgtaagcggtattgatcgtgaaaaaaatctagtcgtgattaaaccttccggagtggaatatgaggtaatgacgcctgaagatatggtagttgtggatttattcacaggtcgagtagtggagggcaataaaaagccttcatctgatactgctacccatctaatactttaccgtgaatttccaacacttggtggtatcgttcatactcattctcgtcatgctactatatgggcacaagctggggaagatttgattgctgcaggcacaacccacgcagattatttttatggtgctattccttgtacacgcaaaatgacacctgtagaaattcagggtgactatgaacttgaaacagggaaggtaattgtagaaacatttcgtgtacgagggattgatcctaaagatgtgcctgcggtattagttcattcacatggtccttttgcatggggaaatgatccggataatgccgtacacaatgctgttgttttagaagagattggctatatgaatttatttagtcgccaacttcgtcctaatttatcgtcgatgcaacaagagttgctggataagcattacttacgtaaacatggtaagaatgcttattacggacagtaaatatgacataagtgctaaagtaaattgctttagcactgagttttagatgttattaagaatagcgtctaagacagaagcaattcccgctttatcatgatgtagagtaaccatgtttgcttgttgtttaatttcgtcctctgcattacccattgcgacacccagtccaactaatttaagcatagaaatatcattatgattatccccaaaagccacaacaaattgagggtcaatgtgccatgtgtttagtaactccaataatcttgagccttttgtatttccgctattggcaatatcaacacgatcaacccatgaccactcacaactaaacccaattgaagataaatgatcaaccgcagtttgcatcaaggcatgatcaggatggctaattacaaatttccatatcgtttcctgatcatttaataacacattaaaatcaggaacatggcgtagtttgggatgtacttggggaggacaacgctgtacccattcggaaaatttacgcagatgctcattcattattgagtaattcattgtatcacgtgaatacattaataaatgtaaattgtatttttctgccagttgaatgacttgtcgggattgttctaaagagagaggatttgctgcaagtacggtatctgtttgtggttgatacatataggtaccgttacaacaaatcatgggagtagttaaactcagctcatggtaataaggataggcggcggtatgatgtcttcccgtgactaaaatgacttttaagcctttatcaatacaacgttgaatcatgattttatttgacgttaaaatttgcccttggctatttaacaacgtgccatcaagatcaaatgcaatgacttggtatttcatcttttttcctgttttgaatattatttagttggtacagtatagagctttttaaatccaaagggaatatattagtctttgcagggataggacaactgtataattctgtataggaaaattaaataaaactgaccgcacttttatgctcaccttataccgctacgatgcaattattttcaataggtacaatgatgaaatgtgttatgattaacacatttccagttttgatgtagagtaaattatgagtcaacatgaatctcacttcaatcattttgccttagccgaactgtatccttttgctacacaatttcctttgcaaaatataataggaaaaaaaggaatacgaatcgtctatcgccattttgttcaagaacattgtgctgaacgtagattagtgattttggtcaatggacgtgcagaaaacttgttgaaatggacagagttggcttatgacttttatcgacaaggctatgatgttttagcgtttgatcatcgtggacaaggctattctcagcgtttattaaaagaccatgacaaaggctatattgatgagtttcgtttttatgcggatgatcttactttgttagtggaaaaaattacttcgttgtatcactatcgtagccaacatattttggcacattctttaggcactttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggtatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataaacacgcctaatgttgtaaaaaacaagcaaccgagaatatgtaacgatgtaatagttatgccttctagccatttatgttgaagcagattttcaataacttctgcactgaatgccgaaaatgttgttaaactacctaaaaatccagttacaaaaaataggcgatattcagttgaaaaagcagacgaatgccaaaacatagccagcattattcccataattaaacaaccgatataatttgcaattaatgtgccaaaggacaagaaagtaaacaacggattgagtaataatgtcaatccatgacgagacattgcaccaagagaagcaccacagctaattaagaataaatgtgtaaatagattcatatgtgtataataaacagaattaaatgatattaaatagcgtgcagagatacctcgctaccgattcttgtgcgtttaacccaatgatttctaaattcgggcaagctgactttaaacgtggatcagcattgctcatcacacaacctttaccaacttgggttaacatttgtatatcattcataccatctccaaaagcaatacattgctgcattccataattccgctcagctaatacctgctctagtgcagtggcttttgatacattttgattcattatttctaaacaaacgggagttgaataagtaatgctgagtttatctccatatgtggttttgagagatgtttcgatattgactaagtcttgcggttcacggccaaggaaaaacactttttctgtagtttttccatgatgttgagcaaaattcactactttatacataaaaccggaatcttgatggtatttacgcaactgaggaacttctgtattaataaaccaatcatccccttgatatgaattaacacatatatgtgtacgatcaaaaggtaagttcataatttcaaatgctattgtttcaggaatgtaattgcggactaaaagattgccttgcaaatcctgtgctcttgcaccgttagaagtaatcattactgcattgttgatcttaattttttttaagattggtagcaaatccgtatggttacgccctgttgctaagataatatctataccttgagatgcaagcttttgtagtgtctcgatagtgaaatcgccaatcatatgattggcattaagtaatgtaccgtctaaatcagagacgatggcacgaaaaggaacattttgcatagcctatctttatcctatactgaaatcacagaacagattatttaacccaagtgacgatttcattaagggatttacgggattttggcttaatttcttttgctcggtagccgaaagttgccattaccgaaactccccattcgtctgaatctaatacacctgcgtcagttaaaatttgatttactttttcataattaaaaccttcaattggacaactgtctattccaattaatgcagcaccagttaacatatttgctaaggcaatataggtttgtttacttgcccagtcaaataaagtgcggtcattctcaagcgttttcatatgttctgcttgaaagagatgatatttttctttggtagcttgtatttgttcgccggataacccacgtcttttcatggattgtactaaaaattctgaatcatagcgtgcattctttttcgctaagataacaactaaatgactggcatcgtcaatttgagttgccatcccccagctgacaggttttaattttgcccgtagttccggattttggattactaaaaaatgccaaggttcagagccgacagaacttggcgaaaggcgagcaaattccaaaacataagagaaatcttcatcgctgatttttttatttggatcatagtaacgtgtggatgcacgacgattaaaactatccagcacgtgttcttttgaaatagtcgtcataataaatgtcctttaaatatttagcgaattgccatttggaataaaaccacttcagcttgacaaccaaaaacaatacgcatttttaaacgaaaaccatttgaaatgtcggtaatttgactctcaatatttgcagggtcattttcaatatcacgagctttctgaataaaataatcacgagcgtttaacgcttgtttttccgtatcgtattccgcttcaaaaacaacttctcttgcggaattatccagcattgaatcgcctttgatacggcacatattgtgtgcttctgccactttttgttgcaatgttttatcactcatgattatttccttatgtttaataaattaacctaccacacttggtaataaacctgcttgaactaggaatggaataatcacaataaatacaccaataactaatacagcgataagggaggcggagccaccttttactcgatacggtaagtgcgggtaaattttacgtaatttccataccattgcaataggtaaaacgattgcatagaatgcaaacatttgtcctgcatatcctaaagctagaataaacccttggggatagaatagtgcaaaagcaagtggcggtaagaaagtgagcagaccaactgaaacacgattagctgaaatatttactcgttttagcagatcttcaattgcttcgaacaaacctaaggcaacacctaagaatgaagtaattaatgcaaatgcagagaatagacgaactgcaccgccaataatttcacttcctgtaattgtaattgttgctgtcaccaatccatttaaggttggatcttgttgtaagattgccaaaaattctgtttggcttagtacgccatgagtggctaattgccatagaatataagcaacaagtggaataaaggttccgactaagatagaaacgcgtaatgcctttacatcgccatcaaggtatttattcaggctgggaatagaaccgtgaaagccgaaagaggtaaagaaaatagggcttgctgagatgattaaggcattatcaattggaagtgcgagtaagttttctaaagagactttaggcagtaataagaaaagcactacaacaaagaaagcaattttactgaaaaaaatgatgcgattaatcttatctacgctatttgtgcctgaaataatgaaaataccgaaaagtacagtaaataatacacctgcaatccgagatgtggtttgttcatcgtgaatggtgggcaacagtcctgcaagtaaagagcttccgccggaaatgtaagctgaaactaaagcgtaaagaaaaattaacagtacaacagtagaaagaatacgtccgaaagatccgtaatatttttcagccaaagtcccaattccagcatcactgtctacagtctgatatagctcaacgaaaagtagggcggcaaaagagagtaatagccaaagcccgattaataaagtaagtgtaaagccaaaaccgattccggctgaggttaatggcatagcgagcatgccaccgccaattgttgttcccgctacaataagcgtacttccaagcgttttgttcatatttttctcccataatgaaaataaaagtgcggttattgtaacttatatttttttaaaagtgtaattttatttttacaaaatgtaatattatgtttacatatttgttttaggaaagagaattggcttaggatcttgatagaacaattgtactttttgtccaatttctaaggattgcattgtttgaatggtgatttgttgtacatcagatagagtaacttggtactgataatattgccctaaaaattgactttgagctattgtgccatgtccctgtaaagttggtatgacctgaatttgatgcgggcgaaccagccaatgtaactccgtattttgtaatagtggagattgatcagcgagtgtgagtaagttgtcgataggctgtataccaaagattgaatgtaattgattttgttgatcaatatagcaatcaatatagttatatttacctaaaaattcagccacaaatttactgttaggttggtaatagagttgatctgttgctccgacttgaataatttttccatctttcatcaatgcaatattatcggcaaaagcaaatgcttcttctttgctgtgagttacaaagattgctgaaatgctttgttgtttcactatttgtttaatctcatcaatcatttgatagcgaacttggctatcaatatttgaaaaaggctcatcaagcaatagtagttttggcttgcatgctaaggctcgagcaatagcgacacgctgttgttgacctcctgacagttggtgagggtaacgatcttccagtccatctagatgaactaagttaagcatattttgcgaaatttgctttttttccatcgcactttttttatccaaaccaaactgaatattttctttgactgttaaatgaggaaaaagagcataatcctgaaaaataaaacctatgttgcgttgttctacagggacaggtgttaaatcttgtccatttaagtagatttttccttgtgtaataggctgtaatccggcgatggcttttaatagtgtcgtttttccgcaaccacttgctcccaataaacataaaatttcattttttttcaattctagatcgagttgatgtaagacaatttgttgtttgtattgacaactaagtgattgaattttaagactattcattatcgatccttttctgaatgtaaaatgagtgaacgagtgagccaaataacagggattaaaccaacgagaattaacgttaatgcaggcaaagcggcatgttctaattgttcatcggaagtaaaagaaaaaacataagttgctagggtatcaaaattaaaaggtcgcaataacaatgaggcgttaagttctttcatactttcaataaacaccattaaaagtgcggttaaaattcctttagaaagtaatgggaagtgtactttttttaacatttttatgccattagtacctaagctttgacttgccatatctaatgtaggaggaattttttgtaatgatgtttcaatacttccgagagccatagcggaaaagcgaatgacataagcggaaactaaagcaaacattgatcctgaaaaaattaatcctacaggagataaatttaactgagccagtatagcgttaatttgatgatccgcaaatgtgtaaggaattaaaataccgatcgctaaaactgtacctggaatagcgtagcttaaactcgcaaagcgtaaggtgaattgtgcactacgttgtatgtgatttgaatgtagatttaagcgttggtaaaaatgtaaaagtagagcgaaaattacacaaacaattgaggcggtaatagaaactgacaaactgttataagcatattgtgaaaatttatagagttgtgattgttcaaaataatgaattgcccaataactcaattgtgcaacaggaataaagaaagcacaagtgactaatccccagcaataagtttgtactaaaaagccttttattccttttaatggcttaagtgcggtctttttttcataccctcgttgataggttttttgtttgtaacggctataattttccagcaacaagagactaaaaataagcaataaaatgaacattgagatttgagcagccgagccgagatctcccagtcctaaccaagtgtcataaactgcggttgttaatgttggcactgcaaaataagatacagtgccgaaatcgcccaaggtttccatcgcaactaaagcacaaccaatagcaattgcagggcgagttaaaggaaaaataattttttgtaataacttgcgtggtgagcttccaagtaatttagcactttgaattaaattttcgctttgttccaataaggctaaacgtactaataggaaaatgtaagggaaaagaactaaagcaagaacaatgcaagctccccataatgttctaatggaaataaaccaataatcttgtgcacttgaccatgaaaaagtttgccgtaaaaatacttgtacagcaccggcatagtctaataaatccgtataaagataagcaactaaatagccgggcatagcgagaggtaaacacaatagccattgtaagattttttgtccggtaaattgatattgagaaataaaccaagcacaaggcaaagcgaaaactaaactaaaagaaacagttccaataacgagaagcaaagagtttagcagataatcaaacagaacagtttgccaaagatgttgaatgttttgccaattgaggctccaagattgataaaaaatagcaatgatcggtgttacaaaaaacaacgtaataaaaagtgcggttaaaaaccaaataattttatttaatcttgaggaaaataaaaacattcgaaaactaattataaagtaatgtaaagtttaatggggcaattatagcataaactcaaagtcagtgagatcattaaatgcccagtttagaaacaggataaacaaagaaaaaagcctagtggatttagcatactaggcttattcttttagcaaatattaaagatcgaatttaacttcatcaataagttttaatgctttatcgtagttttccgctattttatttagtggtagcggatctttcttaaatgttccccaagattttactttttcagacggttcaacaccagcttttactggatattcatgattaagctctgcgtataaatgctgtgctttatcaccacttaaatattcagcaagtttaattgcattttctttatttggtgcatattttgcaatagcgataccgctaatattaacgtgagtaccttttgctttttggttagggaagttgatataaacagcctccgcccaagagcgttgtttttcatcgtctagcatttttccgaagtagtaactattgcctaaagaatagtcacatacaccttctttaattgctttaacctggtcacgatcgccaccttgtggtttttgtgccaagttgttttttagtccttctaaaaatgcttttgcttttgcttcaccatcatgagcaatcatagaagcaacaagagaaacgttgtaagtgtgtttaccagaacgcacacaaacttttccttttaattcaggttttgctaagtcataataagtgaaatcagcaggtaatttacctacacgatctttagaagtgtaaatcgcacgagcacgagttgttagtccaaaccattgatcattagcatctctatattgtgctggaatatttttttctaagatttcgctatggataggttgtgcaagacccgcattcacaatttccatcacacgtttaatatcaacagttaataatacgtctgctggacttaattcaccttcacgttttacacgttcaactaagcctttattatcaaaaagaacattaactttaatccctgtttctttttcaaactcttttaaaatcggttcaataagataaggttgacgataggaataaacattaacttcatttgcagctaaagcactggcggaaacggtcgctgctaaggctaaggttaatgtgctgagtgattttttcatgaaaactccttgtaagaataaatattaagtaaaggatacgaaagagctgtattaaatactttaatagattaaaagtcaataagaattattcttgattgtgtaagtaaaattttaaattttatgaccgcactttacacaaaagggaaaataacttgattattttcccttttaattcaatttggtaaagcggttattgccaatattttttctttgaggtttgacctattcccggattgaaactatttgttgggtcaagggctttgtagaatttgcgtaattccggttttgcttgatacaaatgcccaacattatgttccgccggatattccgcaccacgctgatctaataaatcaagcatttggtgttccaattctatacaattatgaccttttttaatgatatagtcttggtgaaaaacatggcacataaaatgaccgtaataaagtttgtgtataattttattttcaatttcagcaggtaatttttcaaaccattctttgtcattacgacgcaaggcaacatccaaagcaacgatatcttcaacatctttatcgtgaattgcacgataacgaattgcagctgaagcaacagcaaaacggtgtaacattgctgcttgagtttcttctgcattacattggaaataattacctttagagttatcggaaaaatactcttttaagtattcttgagcttcttgaacacctgtaccacctatttttacaataagatgatgttcatattggtcacggtattgccataaagatttcggtaaatgttccggcatcgcttttgataaaatttgcataaacttatcactgaaatcattgggtaaaaaactgacttttttggcgattcggtcaactttagctttcaaggcaaataatttaggtaagcggtgtgtgccaaattttttaataatccaaaaagtatctttaccgtatttggcggcaatgtcaaaagcatcacgatgaatatattcgccagagattggcaattgttggaaattagctaacatatggcgacgaatgtcgtttaacacatctgtttgatttgttccaatgtagaaaactgcggtatgtttttccatcggaaacgtatctaagcggactgcaaaaacagctaattttccggcactcccggaggtttcataatgtcggcttggatcagcgttaaatcttgctggagagttttcatcaatttggcgtacatgttcgcaataagaatgatcgtgtcctctgccacaatgttgttgaatatctttgcgttgataacgttggttttgtaaattttccaaaatttcttcaggatcattacctaagtcaatgcctaaatgatttttgagttccaattctccctgttcattaagttgagcataaagtgccatttctgtgtaagccggtcctctttgcaccaatgcaccgcctgaattattacatataccgccaataacagaagcaccaatacaggatgaaccgataacggaatgaggctcacgcccatgtgtttttaataaaatttccaattcatttaatgtcgaaccaggtaagcaaacggcttgctcggcattattgattagctgaataccgttcatatacattgtattgataatcacaatatcacgatcatagtcattaccgcttggtgttgatcctccggttaaaccggtatttgccgcttgattgataataattacatcagcctcaacacaggcttttaatacgttccaatattcaaccaaattggtagggcgaacaacagcaatcgcatttccgttgccaaaacgatagccgctacgataactttcagttttacttggatctgtaataataaatttattgcctacaatgtcggtgagcttggagataagttgttgagttgtcatcgtcataaaatgttccttgcttatttgaaaaaatcgacaacattataacaaatgaatgttgactagaaatgatgaaattctattcaattatacagtttttttgatgattaaaaagataattgagtttgagctaacaataaaagatgagttttgttgagaaatatgatacaaaagacaccgaatttttatttactcttaattaggaaacgatatgtcgaatttacaaaatattattgagtgtgcatttgaacgtgtagcagaaattaccccgacaaatgctgaagcagaacttagagcggcggtagatgaagcgattgaaggattagataaaggtatttatcgtgttgcggagaaaaatgaacaaggcgaatggattgttaatcaatggttgaaaaaagcggttcttctttcttttcgtttaaatgacaatgttgtagttgatggtgcagaaacaaaatattatgacaaagtgccggtgaaatttgcagattatgatgtagaacgttttaaaactgaaggatttagagccgtaccgggagcggttgttcgtaaaggttctcatatttctaaaggtgttgttttaatgccgtcttttgtcaatattggtgcttatgtcggtgaagggacaatggtcgatacttgggcaacagtgggttcttgtgcacaaatcggtaaaaatgtgcatttatccggaggcgtagggattggcggagtattggagccattgcaagcaaatccaacgattatcggcgataattgctttattggtgcacgttctgaaattgtggaaggtgtgattgttgaagaggggtgcgtaatttccatgggggtattcatcggtcaatcaaccaaaatttacgatcgtgaaaccggcgagattttctatggtcgtgttccggcgggttcagtcgttgtatcaggtagcttaccttccaagtgcggtaaatataatctttattgtgcagtaattgtaaaaaaagttgatgcgaagacgttaggcaaagtaggcattaacgaattattaagaactatcgaatagttaaaattcatgtagtttctattatctacctgcctcttaacataagaggcagattttttataaaacgatagttttattttgatacacaaaaattctgtcatgaagtgccaaatctaaagcctgcgttagtaccgctttttctacatcacgtccagctttcatcatggcttccgcattataagtatgatcaacattaatgacattttgcataataattggtccctgatctagctcattattaataaaatgtgctgtcgcaccaataattttaacccccctttcataagcttgatgataaggttttgcaccgataaatgcgggtaaaaatgaatggtgaatattaatcactctattgggataacggctgacgaattcgggatttaaaacacgcatatatttagccaaaacaatataatctggagcatattcgtcaattttttcagctagtaatttatcatgttctactcgagttaatccttcatggcttacacaatgaaacggaatatcaaaacgctcgactaacgaacataaagtttcatgattcccaatcacagcggcaatttctacatctaatccgccataataggttttcattaaaatgtcgcctacgcaatgtgcctctttggtaactaaaattacaatacgttttctttttgcatcaactaaacggcaatttgtaccattcggtaaactatagtctaaatcggcaagtaaagtttgttgattaaaaataccttccaattcagtacgcataaaaaagtgtttagtttcaaaatcaacaaattcattattatgaataatattgagctggtgtttgtaacaaatattagtaattttagcgattaaacctttatcatcaggacaatctgttaataggattttattttcaaccataataaatagtgatttattgtgttaagttaataaaaacttaagttagagatttatagcatgattaaatttcgaaatcagccaatgtttttcctgtatttaattccgcttgcagagataaaggcatacgcccctgccccgtccaagtttttactttaccattttgatctgtatactggtattttgctttgcgaggagctatttttttacgagggcgtttagtggtaaaggttggatcatcgactaaatcagtcaaggttaagccgtcttgtgctagcaatgctttatattttgcgatacgttccaaacgttcttgttcttttcgttgattttcttcaattagttgacgtcgttcatttgtaattaattgaaatttctccaatatactttctaactcttgcagagtgaattcttttgttgctacacgcaatgctcgaatactggttaatgtttttaataggtcagacatttttactccttaattttatattgataattcgctttcaaataataacgaaaaaatatttttaggtaaatcttaatttaaaaatagtctaaattttaattttatatattagtttaattattttacattaattatagattaatacttggaattttgattttcttattgtaatcttactcgctcctacatatgtagaggtgcggctgttataagtaattttttgagtggataacgatgaaaaaaatgaaaggaatagttgccgaaatcaattaaaagtcattttaattggttgggggcgtattcgaaagaaacgtcactgtcatagtatttatccactatggagcgctactggttaggttggtatgggttatttcgatcaccttattttaattatatttaaaatatcaatctcagtggttctcccttaaattaggaagaacaacatggaacttgtaaattattccacatctatttattcggttattccaccgatattagctttgctattagccattgtaactcggaaagtcattttatctttaagcattggtattattaccggtgctttaatgttgaccaaagatacatccatattggatagtattccttatttgtggaatcatatctccgctttggtttatagtattgaagaaaacggctcaatcgcatttgcgtgggacacaataaatattatcctctttttagttttacttggtattttgaccgcacttttaactgtatccggtagtaaccaagcctttgctgaatgggctcagaaacgtattaaaggtcgtcgtggtgcaaaattaatggcggctgctttggtattcgttacatttattgatgattatttccatagtttagcggttggtgcaattgcccgtccggttacggataaattcaatgtatctcgagcaaaattagcttatattcttgattcaacagcagcacctatgtgcgttatgatgcctgtatccagttggggggcttatatcattaccttgatttcgggactattagcaacttatgccattaccgattactctccaatcggtgcatttatggcgatgagttcaatgaatttctatgcaattttctctattttattggtatttttcgtggcttatttttcatttgatattggatcaatggcgagacatgaaagattggcattagagagaggggatacagaaagagaagttgaaatacaaacaaagataaaagggcatgtacgaaatcttgttttgccaatagtggtattgattgtagcaactgtggcaatgatgatgtataccggcggacaagcattaattgctgacggtaaagcctttagcgtgctgggtgcatttgaaaacacaacggtagggatttctctcgttgttggtggaattgcctcagtggtgatggttactctctgtattttaactgatggtcagattagtttaaatgaatatattaaatcttggggattgggtgcaaaatcgatgtccggtgccattttaattctgtgctttgcatggacgattaattcggttgtgaaagatatgcaaacagggacatatttatccagccttgtatctggcaatcttcctattgcaacgttaccggcattacttttcatcctcggtgcagtgatggcattttccacaggaaccagctggggaacatttggaataatgctaccaattgccgcagaaattgcatcaaatgctgcccctgaattaatgttaccttgcttatctgcggtaatggctggtgcagtttgtggagatcattgttcccctgtatctgatacaacaattttgtcctctaccggagcgaaatgtaaccacatggatcacgtaacaacacaattaccttatgcgttaacattagctatggcaacaattgtaggctacttagttgtcggtttcacgttatccggattgttaggttttatcgcttgtggcgtaacattagctgttttaatgttaattttaagaaaacgctaatatcgttttaattttgtttttgaaccgcactcataagtgcggtttttattagagcggagtttaaaataagtgtagaatggacaaaagttatcgttcatttcttatttaggagtaggagcaaaacatggcaatcttagttaccggcggtgccggctatatcggttcgcatacggttgttgaattattgaatcatcattttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgcaggattgaaagcggtaggagaaagcgtaaaaaaaccgttgcactattatcagaataatgtgaacggttcgattacgttactggaagaaatgctaaaagcaggcatatataacttagtttttagttcatcagcaactgtctatggagaccctgaaatcattccaattaccgaaacttgtaaagttggtggaacaactaatccttacggcacatctaaatttatggtagaacgtattttacaagacgcagtgagtgcaaatccgcacttgagtgttgtcatacttcgctattttaatcctgtcggtgcgcatgaaagtggtttaattggtgaagatcctaatggtattccaaataatttattgccttatatcagtcaagtagcagtaggaaaattaccacagctttcagttttcggtagtgattatgatacacacgatggtacaggtgtgcgtgattatattcatgtggtcgatcttgcaattgggcatctaaaagcactggagaaacaccaaaatgatccaggttgtcatatttataatctaggcacgggaattggatattccgttttggatatggtaaaagccttcgaaaaagcaaatgatattcaaattccttataagctagttgaacgccgcccaggggatatagcaacgtgttattccaatcctcaaaaagcattagaaaaattaggttggaaaactgagcgagatttaacacaaatgatgaaagatacgtggaattggcaaaaaaataatcctaatggttataaatcgtaagtcgtaagtgagcgttttaacatacggataagacaattcagctatcaacattttaataacaacagaacaacattgattgtttctgttgttattttaaacgatttagcaaaaaagataggcgataaattgcaaagaataaacttttttctaaaaaacattttctttacatttaaagttaggataaaatcgcccgaataaattaataatacttgacaaataaaaatagaatagaaaaatgtctacagtctacagtctacagtctacagtctacagtctacagtctacagtctacagtctacagtctacagtctagtatattgcctaaaatcaaccttgcaaggtaaatttgtgaggttggacatgttcaaacaatatcttaaaaatcacctatttcaacctcaacctttcggcgaaagtattattcgcctttttttgttgtgtcttaaaaagcaaggcatcgccgatttattcatcaaactatctaaaaagcaaaaagtttaattaatcaaaaaccataaaaaagttaaaaaaaatcaacaaaataaacaattgaaaaaaacattttaaaagattaaagagagtgaatttatgaacaaaatcttcaaaaccaaatacgatgtaacaacgggtcaaacgaaagttgtgtctgaattagcgaataaccgtcaagtggcgagccgtgttgaggcgacggagagtaagccgaagtgcggtgtgtttttaggcatgtttaaggtgttgccgttggcgttggtggtgtcggtagctctctcatcaaatacttttgctgcatggataggcacttatggaggtactgtaggttcagaaaaaagagaaatggaatatatttataaaggtagggataaatatagattacatggagttgctttgaatccttcaggaaataataatggctcaaattattctaaagttagtataggaggtgtggctgtaggacatgatgcttgggcatcaggggataattcaacaggtgttggggcagacgcacacgctataggtatgcagtctgtggtagtgggtaataattctggagctaacaatcagtctgtcgctataggaagtgacgtatttgcttatggtaaatctgctattgctattggtaatgatgatatagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggttgggacaaatgtacataaagaaaactcaatcgctttaggaacgggcacaacagtaacaggtgcgggcgttgtggctatcggttccggcgttggtgtaacaaaagacaatacaatagctgtgggttatggagcattgggaaaatcaggagaaagtattgttttaggtaattcagcaacattagaagagcatgcctcaaaatctatcgtgataggtaatggtgcaaaagttgaaaatacaaagaaagatgacacaattaaaaaactaagttggcctgaggatgaaaaatataggaatggtgaaaaagaattagaaatgtcggctattgctataggaactagtgcaacagctaacgctcaaaatagtgtagcgttcggaaatgaagctcaagtaagcatggaaaattctgtggcattagggaataaatcacatacaaaatatttctatcaagatgataataacaaaaacatagccacgctcatcggaaacggcaaaaatgatgcgattaatttagatccctatgttccagagggttctagctataacttaaaaaccgataaagcggcgggtattgtgtccgtcggttggacaaaaaatggcaacggcaaaacacaagaactgggcttaagacggattgtcggggtagcaccgggtgcgttggactctgatgtagtaaccgtagggcaattaaaagcgttatattacgttaaaaaagaaggcgtggtgacttactatactaaagacggaaataatattatcaaacttaccaaagatgctgatggtaagttctataaagtcaacaccaaagacggcacgccttacaaggacttaggtgcggttgacgcaaaaaatgttttcgttggtccaaaaggggcgaatgaaaccaccaaagaagaaacgattcagcggaaaaaatactcgcttggcgatatgggaaataaaattaaattcgctcatattttagatggcaatattgaaacaggatcagatcaagcgattacgggcaatcagcttcatcagcttggtagcactatcttagggttgaaggttaaaaatagtaaaacagaatttgagaaagtccaatttgaagcagtagaagtaacagatccaaaaaagaaaacgggaaagacagacacttttaaagaagccttaactgaggttattgaggcgattaatagaggttataaatttagtgctgaccaagtaaacaataaagccaatgaaacacctttctatcttggtgctaccattgaaattaaagcaggggatgttacaaagccaggtaacacgatagagaaatatctaggcaaaaacctaaaaacagaatttaaaaacgatagttcaaaagcgacattcaccatcggcttgaaagaagacccgagctttaaaaaagtcacgattgaagacacgattgaggataaagaagctaataaaaaacttgccgtcaacaaagagtatgtggataacaaactcaaaaacgtctcaaccaatttgcatttcttatcagtacaagggaatgataaagccgcagtcaactataataacgatggagcaaaagcaaattattctgttgctattggggtgaatgctcaagtagcagatcctattaatagtggagtgcctaaaaacaaaccaaaaccgacagcaacagcaggtatagcgataggatataacgctaaatctgaagcagaaaatgcggttgctataggtagagatgtaagtattgacgtaccgaattcttttgttatggggtctaataatattgtgacacaaagtgataaggatgtaagaagtgcggtcgttgtaataggtagtggaacaaaattagtagaatcaaaaagttctatcgctataggtgcggtttatgtggaaagaggtgacaaaaaagatggtactgtaatagagaatgcggcttggacagcgtctatagggaataaaaataaaattaaaaacggtacggatattgttgctgtaggtaataatattgaagttaaagatgatacaaatgaggaaaatccaaaaaataaaacaaaaattgcgaataatgatttaattctgattggtaatggagcgacagctgaaactgcaaaagaaagtgtgcttattggggcaaaatcaaacgccggcaagggtgcaaaaagtgcggtgattattggtcatagtgctaaagcagagacaaacgccgtcggtgcagtagcgattgggcaaggtgcaacagtaaaaaccgacgccggcaactccattgccttggggcaagggtcagaagcgacggcaaaagaagaggctaaaaaagatgctactgtaagttttgacagtacaaatattaaatttaaatggacaggaggcgttagttccaatagtggtgataaaaaatccgttttaagcataggtaagaaaaataatgagcgtatcatcaagcacgtcgctgcaggtgcggtaacggcaacgtcgaccgacgctatcaacggaagccaactttacgctgtcgccgatgaattttctaaattggcggtgaatgtattgggtgcggaaaaagccgacggcgatacagcaggatttaaaaaatcgacatttgacgtggctaaatatcagggaagtacaaatacaccagcacaaaaagaaatgacctttaaagacgcaattggtcaaaatacaacagcgattaataaaggctttatttttggcgttggcgatcaaactaatgaatatggaacgcattacttaggcgataaattaatcatcaaagcgggagcaatcgataaaccgacgacaatcacgacatcagaagatggctattcgccgaataatattaaaacgcactatgaaaaaaatagtaaaaatatattaatcggcataaaagataaaccgacgtttaaaaatgtgattattgaaaatggtattcctgaagatgaggaagagcttaagaaaggtaattatgataagcatgctgtcaacaaaaaatatttagacaaaagattagaaaaagtcgccgctaatttcacggttaagggggataatcctaaggctggagaaggatatacattagataaagatcataatgaattaataattgcaggagatagtaaaaatattgaaactacagttgataaggaccataaaaaagtcagtatcaacttaaaagatactttaacaggtatcacttcaattgctaataatgatacaaaaattgaattaaacaatggaactggtggaaatggaacaaaatctatcgttttcacatcaggagataacagtaaatctgtaacgttaactggcgataaattcagcggagtttctgaaattggaaaagatgatcaggctaaaatcactttcaaaaataatggttcaaatgaaatagactttaaagcagggagtacaacctataaattcactgacagcggattagatttagctagcaaagcaatcacaaatctagcaagtggattagataatgttgtaaataatggtaaaaaagacttagacgagttattaaaacttgttgctacaaatggacaatcaagtggatcttcaaatgatggcaaattaaacaaagcagtcaatgttaaagatttacttcatgtcgctaatgaattaaaaaataaagggctgactttccaaggaaatggcgatgatactgataaagttaccagaaaactgggcgaaaccttaaaaatagttggagaaacatcgtcaacaggtagcacacaaacaacagaaactgcagctggtaacattaccgtcgctaagaaaaatggcacgactaatgaagctgataccttagagattaaattgtctaaaaatttaaaaggtattggatcagttgctaatggagacgatgtaaaaattgaattaaaaactactggaactagtggaagtaatacaaaatctatcgttttcacagctggagatagcagtaactctgtaacgctaactggcgataaattcagtggcgtttctgaaattagtggtaaaaacagtaaatctaaattgacacttggtgctgataacgcaactgtagaattagctcatgacaaatcaaaacttgaattaaaagatactgaagcaacaatcacagctggagataatgccggaagtattaaaattacaagtaatggaagcaagaaaattgagttaagccctgaaaacggagctaaattaacacttgaaaaagatagcactactaatagtggttctaactatgttaaagccactggtttatctcatgtcgggttagataatgataacgctttaatctttaaaaatggaaataacaatggcaataccgctgttttaaaagtgggtaatgctgatttaacatttacaccaaccggaagtaatggaaatcaaaaagtccagatttcaggattatcaagcggattaactgatattggttcttctaccggtactagtggcaataatagtactcaaaaattagatgaattattaaaactaaaaccacaatcaagtggaacatcaaataatcaagacaaattaagcagagcagtaaatgtagaagatttacttgatattgctcaaggcttggttgataaaggacttaaattccaaggaaatgacacttcaagcacaataacaacaaaactaggcggtactttaaaaatagttggagaaacagcaacttcaacatcgggaacaactgcaacaactcaaattaccaccgcacctgataacattacggttaagaaaaaatcaggtagtgaagatactttagaaatagggttatctgatgctttaaaaggtattacttctattagtggtaaaaatggcagcaatggaagtgcggtagcgaaaattgaatttacgaatggcggtactggtggcagtgcttcaaccagcccaacggtcaaaatcaccgctggcggtggaacatttacctttggtgacaatggattagatttaggtaataaaaaaatcactaaacttgaaagcggtttgggattaacaaacggtgtcggtacaggtggaagtactgtaaacggaaacgaggaaattattaaaaaagtcctcgaaggaaatcctgacggcactaatggttcccctaaaatttccaacaacgccgtcaacgtcaaagacctgtccgaagtcgccaaagcgattgtgactaaaggcttgacctttgcagggaatacaggtgaggctaaagccgcactcggcgataaaatcacgattaagggtgatggaacgtatttgaccagcaaggcttcttcaaatggtagtaaagaaattgagttttcattgacggatagtacgaaaaataaagtcgatattatcaatgtcggcactaccaacaacggcgacaattcctttgcgttgggtaaagattccaaatgggaagggaaaaagaccgcacctagtggaattataccgaatgcaggaaaagatgaagtcaaatttagctggacaacagcaggggcttctaaaactacaaatcctgttgatatgaaagaagtcattagtgttggtaatacaaacgctgaacgcattattacgcacgtcgccgcaggtaaagtcgataccggctcaaccgatgcgattaacggtggacaactaaaaagcgtaatcgatgtctttgctaatttagggataaatgtattgggtgcggagaaagccgaagctgacaaagacggctttaagaaaactacatttacagcattgaaaaatacaagcggagcaaatgaagcaactaaagacacatttaaagatgcaatcaatgccaatactgccaaaatcaacaagggcttgaaatttaaaggagatactaacaatggaagcaacggcgagcaacaactctacctcggctcaaccttgacgattaagggagcggaaaccaccgcacaaacatctactcaaggtgcgggtgcagccaaacatcaaaacattactacaacggcaaaagatggtggaatacttgaaatcgctttgaacacgaatttgaaggacattacctctattgggaaagatgaaaataatgttttaacgtttaaaaatagtacaagtggtggaaactcagcggacttaaaagtcggtggagcctctttaacattcactaaatcagataatggtgacaaagttaaaatctcaggtattgcagatggtgaaagtgagaacgatgcggtaactgtcaaacaattaacctcctcaaaattgcactatttgtcagtgaaaggaccaaatggaacttcaaatggagacaattacaacaatgacggtgcaaaagcccaaaattctattgctataggttctaaggcaagtgtaaaagacgacaaatcacacgatgccatcgctattggttataactcattggtagaaaacgcaaaatggtcaatggcaattggtgccaatactcaggctaaatccattcaatccttagcgttggggtatcaagcaaaagtattggaaaagagtgatgcttcaatagccatcggtgtatctgacacaaaaatagaaaatgctaaatgggcagtagcattaggaaacaaaataacaataaatggttccggtaataatgttgttgcaataggaagtaatattaatgtaggaagtggcaacgatgatttaatcgtaataggaaatagaggcgacagttcaccacaaataacaaacgccaaaaactccgtcattatcggcaaacaggcaatttctcaagctgaaagtgcggtggttattggtaaaggtgcaaatgttgaaacaaacgcaacaggtgctgtggcgattggtgatggtgcaacggtagctgaaaccgccggagattctgtagcgattggtaaaaactcaagagcagatgaaaaaatgtttgcaccggacggaatagacgctaatgttggtagtcagtcgttgaaaatcaattggaaagacgcaggtgcttcagctacagataaagattataaatcagtgttcagcataggagatgctggtaatgaaagagtaataacaaatgtagctgcaggatatgtaatagatgggtcaacagatgcagtaaacggcggacagttatatagtgtaatacacacatttggtaatttagcaagtgatgtacttggtgcagaagttaatactgatacggataaggaggcagatggaacacctaagtatggcttcaaaaaatcaacgtttgttgcggtgaattataaggatagtacaaaacaagcgaaagacacattcaaaggtgcaattgatgaaaccattaccgccattaacaaagggctgaaatttgccggtaatactggtgaaaagcaacttcaactgggcgatactttagcgattaaaggtaaagaagatagtgcaaacagctcccataaaaacatcagcacagaagcgaaagacggtggtattttggaaatcgccttgaattcagagttgaaaggtattcaatccatcgctaatggtgataatgcaaaaattgctttggataaagacgcaaaaaccattaaatttacctcaggggatacaccgacagaggttagtttaaaagctagtaccttgagcggtatcactgagattaataaggcaacggacaagggggcgttaaaactcactgagaacagtgcgaccttagaaagcacgaaagacaattcaaaacttgaattgaaagacaaaacggcgactttagaaagtgcgaaagataagtcaaaacttgagttagcagaagacagtgcaacgttaagtgcgggtaatggtaaaggaagcattaaagttagcaatggaacatctaacaaaatcgagttaagcccggaaaacggctcaactgttacgtttgcaaaagacacagcaaatggtaatactgtcaaagccaccggcttgtctaccatcggtaaagatgagaataacgctttagtgtttaaaaacggtacgagtggcacaagtggcacgaacacggcagagttaaaagtgggtggtgcgacgttaacattcacgccaacgaatggaactggaaatgctaagaccgtgaaaatctcaaatgtggcggttggtaagatagaaagtagttcattagaagctattacaggcggacaacttgccgatttagctactcatttaggggttgatgttgatagctcaggtaaaactgcgtttacagcaccatcatttaatgcgataaatggcggtacaactcaaaaaacctttaaaggggcgattgatcaattaatcaccgccgtgaatggtggcttgacctttaaagggaatgatacttccccaacttcaaccacattacaattaggcggtacgttgaccattgatagctcgacggttggtagcggtgctaatggaacgactgaaaaagacatcactgtatcattagcaccaaatgataaagatgttaaagatgccggtacactcacgcttaaattaaataaagcgacagaagttaaagaaggcgatgaaaaagtcgtgacttctaaagcggtagcaacagagttgaaaaaatatacgacaacagctgatttagataaaggctatctcaaagtcgatgggtcgaatattggtgaagatgaagagaagaagaaacaaggcagaaaaacattcggtagcaatgtcggtattgctgaaatcaagttagatggtgaaaaaagcagcactgaattagtacaggcggatgcggttatcaagtatctaaaaggtaaaggtgaaaaatcagttaaagtatccgataatccagaaactgaggctgaaggagtcggttctattgcgattggcgataaagcgatagcaaaaaatgaaggggcaattgctatcggttatggtgctaatgctaaaaatagaaacgcactttctataggcagagatagtgaggtattgggcgagcatgctacggctattggtttccaaaataatgtattgggtaacgattccggtgcattcggtaaagataataaggttagcggagagcatgcttatgtattgggtgcttataatgaaataggcggcgaacacacttatgtcttgggttcaagtgtcacgacaactaaagatataacaaatgctgtcattttaggcaataaatcaacaggtgtatcgggagcagtatcagtaggtggtgctggcgatggcgaacaaagaagaattgtttatgtagcaaacccagaaaatcaatacgatgcggtgaataaacaatatgttgatggacttggattaaaattcaaaggtaatgatagtcaagagatccgcaaaaaattatcacaaattttagaaatagttggtaagggtttaaataaagcccaaactgctaaatttaaaggcacaaatggaaatattgccgttaaatcaagtagtggtaaagataaaaaattagaaatatctcttaatgagaaattatcaaatattaaaacaatagaaaataaaggtagttcaatagaatttaatgcaaatgataaaaatggatctagcaaaacaattaaaaatttacttcttacaggaaatggaacaaaaatggttctttcttacaaaggagtacatttaaatgaaaaacaattgattggactaaaaagtggactattagaaaaacacaacggaaaagatcaagaaagaaaaggtttagacgatttaataggagaaaattttgataaatcatcgattaaaactcatgccgtcaatgttggagatttagctaaaatttctaaggaaatagttgaaaaagggtataagtatagagcggacattccgtcaggtaatagcaatgataccagcataaaactaggctcaaccatatctattgttaaatggacagacacaccggcatcagggactggacaaccagctgttaagtacacaggagataatttaacaactcgatatacctatgacagtggcaacgctaagatagaaattggatttaaagacgcaccgacatttagcaaagtaatgcttgctgaagaacaaacatataatgacgtaaatggaaatggcggaagaggaactagcggaaatacagattggaaaaaagaactcatcaccaaaggctaccttgaacaagcattagataagtttaagttcaaggttgttaatggtgatggtaaacctattgaaatcggtcgtaatgatacgttgaagtttaatgccggcttgaatattaaactagcgttagaagagggcgaaaaaccggcaaatggtacaacgtctaccagtaccacaagtgcggtaacttcaaccccagcaccagcagtggcaagcagtccgtcaggtggtacaagtacaaacggcggtggtgcaaatagaggaggtagctcaaatggtgcaggttcaaatggtggcggttcaaacgggatggcttcgccaagtacaaccgcttcaactggtactggcatggctacgacaggtgctacctcaagcacaatgccaacaagtacaccaacaaccactactacaccaccaacaacaacagctgtagtaaccattggtacaaaaaatgatttaactgatatcacctcgatttcttctaaacctaaagatggaagtacgggcggaaatggtgctggctcaactggagaagtgactaaacttaccttagatccaactgatggtgcgactttccaagtgggcaagcaaggtgcgaaagttaatattgataatatgggcatgaaattcacaccacaaggagcgaatggtgcaggtggggcgaatgatccaaatgctgacaaaccatctattaccattaacgcaggttctgtatcagctgctccaaacagttcagcacaacctgccgaaccaaacttgcctgctgttgataacggaccatctattactttctctacaaaagacgagaatggtaagaaaatcggtttcggtacgatcaaaggtcttgcggacattaagccgaatgaaactgatggaagcattgcagcgaataaaaactatgttgatagcaaaataaaagaagtgacagctggtcaaccttttgaatatgctacgataaaggataacgctaaagttgtgagagggttggacggtaaactgtataaagaggctgatctgaataagtattattacgatgagaaaactgcttcatataaaccaagggatccgaaaaattctagtatgactgagttaaaagcattaaaaaatgatgaggttatcgtaaacttaatgccaaaaggagatgataaatctccgatagcaattggaaatgtaaaaagtattttagatgcagaggcttcaacaaaccaagataaagcagcaaaagcaattgaagagcttattaaagaacagggaacgttatcaactaagaaagataatgttgcgacaggttctgatatagccgctttggcgaaagcaggtctgaattttggtgtgagtgcaggagaagatgttcatagaaatttaggcgaaaaaatatctattgtaggtagagatctgaaagcagaaattctaaaagaaatgaacatttctaatggaaaagttgatgatgataaaaaagcggaatatgaagctaaattggcggtagctaagaaagcaattgctgatggatttagcactaagaacgtggttactattgccaatcaaaattctgttgtgatcaatattgcagataaacctgagtttaaagctatttctattaaagatgaaacagcacctggcatgtctttagatttaaatccaaatgcgattagtatggaagacgatgatggtaataacacagtcatggatgctggcggtatggtagttactgataataacggaagtaccgaagtaaatgccaacaatattagtttgacggattccgaggacaaagaaagcaatttagaagcgggtaaattggtattgtcccatacagacaaagagcttgttattgaggcgggtgaaaaaggtggcaagataacaggcctggcagttcgtcatccaacagatagcgattatggtactgatacaactcgtgctgcaacggaaagtgcggtgaagaaaaaccgagatgatgttgaggatggcgtaattggtccgatggtttatactgataacaaaggtaatcgcttagttaaagtagaaggtaaatattacctcgtttcagatgttgaaaatggtaaagccaaggaaaaagccaatgcggtggcaaatccagctctgtcgttagtgaatgctgatagaaatggaggagatacaaaagcccctgttgtgttaaataatgttgcagccggagaactttctgaaaatagtcgtcaagcggtaaatggggctcagttacatcaaactaatgtgcatgttcaaaacaatagcttgcgtattaataacttgcaaaaccaagtcaatatcttaaacaaagatatgcgagcaggtgtggcacaagctgttgcacaagcgaacttgccggtcaatatattaccgggtaaaagtacgttaagtttggcgaccggtaactatatgggtacgcaagcctttgcggtaggttattccagagtatctgataatggtaaacttagcgtcaaattcagcttaggacatggcgataagaaaacttctgtgggtgcgggaattggttatagctggtaattctggacttttcatccatcaaaaaagggcgtttatacgcccttttttctattagtgtcgatattttttgtcaatctaaccgcacttttcgtaaatactaaattaatttaagcaatacctttatgtcgcagtagtgcatctaattgaggctcacgacctctaaagcgtttaaatagaatcataggttcttccgatcctccacgagttaaaatttcatctaaaaatgaacgacctgtttccgcattaaaaattccttcttcttcaaaacgggaataagcatcggcagataaaacttcagcccaaagatagctgtagtatccggcagaatatccgcctgcaaaaatatgactaaagctgtgaggtgttcttgcccaatccacacctttgatcaccgcaacgtcagatttaacctgttttaaggtcgctaggatttgatttggtttattagcttcaaaataatggtgtaaacggaagtcgaataaaccgaattctaattgacgtaaaacaaacattgccgcttgaaagtttttcgcttttagtaattgatctaatttttcttttggtagtggcttgccggtttcataatgtcctgagatgaatgctaacgcctcttcttcccaacaccaattttccaaaaattgacttggcaattctactgcatcccaaggtacaccattaattccggcaacatcagcgacatcaatttttgtgagcatatgatgaataccatgtccaaattcatggaatagggtagtgacttcgtcatgggtgaataaagcaggtttgtcgccaatcggagcattaaaattacaagtcaggtatgcaacaggtttttgaattgaaccgtcagctttacgttttcgtccaatacaatcatccatccaagcaccgccacgtttattttctcgagcataaagatctaagtagaaacttcctctcacttcatttttttcatcaattaaatcaaagaagcgtacatctttgtgccaagtgtctacgtcaaaacgctctactgctcgaatattgaaaattcgtttaattaattcaaatagacctgaaataacttgatcttctggaaaataaggacgaagttcctcatcattaattgagtataaatactgtttttgtttttcgctataaaagctaatatcccaaggttcaagtgcggtgatattataatttttttggcaaaattcttgtaattcggtcaattctttctcgccttgattttttgaacgttttgctaaactttccaagaaatcaataacttgttgtggagtgtccgccattttggtcgcaagagaaagctctgtataagtattaaagcctaacaaatgagcaagttcgacacgcaaagtcaaaatttcttgcataacatctgtattatcccattttcctgcatttggtcccagttctgaagcacgagtagcaaaagctcgatacatttcttctcgtagttctcggttttcacaataggtcatgacgggtaaataactagggaattccaaggtaaaacgataaccatcaagccctttagattgtgcggattgttttgctgcttgtaatgcactttcaggcaagccaattagatcttgttcattttcgacgactttatcccatcccattgttgcatcaaggacattattactaaatttagcgtttagttcagataaacgagcaacgatttcaccgtatctttgctgtttatcttctgataaggcaatacccgataattcaaaatcacgcaacgcattttctatcgcttttttttgtgcaaccgtatattgggtaaattccggactattttttagttgcacataggcattatataaccctttatgttgccctaaccaagtactatattctgaaatcagcggtaaacaagcttgataagcggcacgcaattcaggactgtttttcaccgcatttaaatgagaaacaggcgaccaagcacgaccaagtttttcctctttatcgtttaggggttgaataaaattctcccatgtaaagtgcggttgttttaacacttgttctaccgtttcacgattttgttggatcaattgctcaatcgccggttgaatatgttcaggtttgatttttgaaaattgtggaagttctgaatgggttaacagtggattagacataagtgttcctcaaaatagacagttattttatataaaaaagtggtaagtagattgggatttattctagaaaatcaaggttgaggtctaaaaaatgtgaataatttaggggtattttattaatagttcataggaaaatttttattttgttttcattttatttttcatatcttattttgtgtactagatcacaaaaaagaaaaaaagtaaattaaatattaaaattaataatttaaaagattaatttcaatagataaacttacttaaagttagaaaacaggggaattccatgaaagagttatctgtggattgtattattgagcggagagattgtcatagtgctaaatgggaattagcaaaaaaatatagtgaagatattattcctatgtcggtagctgatatggatattccttcacctagagagttaatagagtatttaggaaagttaaataaaaaagggatatatggatatactatttttcctaataattataaaaaaataattcaaaaatattttttaagacattatggaagttatatagatgaagaaagtatagtattttgtccaagaataatacaggctgtttctatttatatcagagagtttacatgtataaatgataatatatctattttatcaccttcttataaaccattggtaaatgcaatttctttaaataaaagaaatgcaattttatgtgatttaatatataaaaataatcaatactatattaattttgatttgttagaagattgctttaagaaatcaaaagtatttatatttatttctccacataatcctacaggaacagtatggagtaaaaatgatttggaaaaaatagccatgttagcagaaaaatatggcgtttttattatatctgatgatatacatgcagattttaatttttccaacaataagcatatttttatttcatctgttagtgaatatgttgagaataattctattatatgtacatccccgtctaaaacttttaatattcctggattagaaatatcaaacttattaataaaaaatacctgcattagaaataaatttaaacatcacttagaagcattgggatttcataatccaaattatttttctgcatctgcattaataattacatatagtaattgtgatgagtggagaaaagaattattggaatatattagagaaaatagatctttggtgaaagatttttttgaaaaagagattcctgagttagaggttgttaatagtcaagggacatatcttgtttggattaactataaaaaattaaatctaaatgaagataaattaaaatattggctcattaacttatctaaaattgaaatgtcttgggggtctgatttcttaagaggtggtgaatatttttttagaatgaatatagctatgccaagaatagttttaatatcttgtttaagaaaaataaaagaaggattaattttgctattagaggaatcaaattatggaaaataatatgaaaagaaaaccgaaattattagaggcattatctccaattttatttatgctatttttattggggtgcggttatgcattttttgatttgccaccagagcctttaatgattctttcatgtgtatttgcaggtattttagtgaaaaagttagggtattcttataatgatattttagattcaatttcatttaaaatatctaaaactatgcctgcattattaattttaattactgttggcttattaattggaacttggatcattggcggtactataccaatgatgatttattatggattaaaggtcattgatcctaaatttatttatattacagcattatttctaacagcaatagtatcaatttgtacaggaacatcctgggggtcagcgggtacagttggtgttgcatttatgggtgttgcaattggtttggatgccaatttagctgccacagcgggtgccattgttgccggtgcttattttggagataaactttcaccattatctgatacaacaaatatagcttctgctgcaactaatgttgatttatatgaacatattgctcacttactttacacaacattaccatcttttctaatttctgctttagtttatattgtatatggatttaatattaatattgataatgtagcaacacctgataaagtattattgatgatttcagggttagaaagtatttataattttaatttatttttattgatacctgtaataattattttgtggggatctatcaccaaaaaaccaacaattccagttatgttattttcagcagttatagcatcatttaatgcaatttttattcaacatttctcattaaatgatgttattaatagtgcattaaatggatttaatatctcaatgttacctgattctttaaatattagttcagatcttgcccgtttactgaatcggggagggatgaattctatgatgggaaccttattaatttgtttttgtgcgttatcttttgcagggatactttcacttagtggtgcattagatgtaatcattaattacttattgagattagtgagatcaacggcttcattaatttttattactattctttgtggtcttactatgattggtgtgacttgcaatgggcaaatttcaatattaattccaggagaaatgcttaaagatgcttacattgacagaggtttacatcctaaaaatttaagtcgtactgttgaggattcagctacaattatagagcctatccttccttggactgctgcaggggcttatatggctggtactttaggtgttgccacattaacttatttaccttgggcaatcctttgttggagcggtattgtatttgcgatgatctacggtataagtgggattggtatcgctaaattaaaacaagagtaacgtaggaagaaaatacttaaggaattactcgtccttttaattaaaaccagtgaaaaagagcggttagttttagaaaattttatatgaagcaatttttcgtatttgtatggtgaagcgaaagctcgatattattaaaggaagatacatggataacacacaaaaatattaccgcattgctttattgttcaacgccaataaggtgtatgatcgagaggtggtggctggcattggacagtatattcaagcatcgcaatgcacatggaatatttttgtggaggatgattttgtttaccataaagaaaccattgaacgactgtctattgatggtattattgctgattttgacgatcctgaaaccgtttccttgttgaaaaatattgatgttcccactattgcggtagggggatcttatcagaattttgctgattatccgcacttcccttatgtcgctactgataattacgctttagtcgaaaccgctttttcccatttaaaacataaaggaattagtcaatttgccttctatggtttgccgactcaaggcaatcggcattgggcaaatgagcggaaaaatgcttttgtagatttaatggaaaaatatgcttatcaattttctgtatatttaggtgataaaactgattcaggcagttggcaagtggcacaatcggaattatgccaatggctacaaacattgccggcacataccggcattattgcagtaacggatgctagggcaaggcatttattacaagcctgcgaatatttgaaaatagccgttcctgagaaactttgtgtgattggtattgataacgaagaattgatccaatatttatctcgcatttctctatcgtctgttgctcaaggtaccaaacaaattggttatcaagcagcgaaaatgttgcatagtctgttaagtggacataaagtgagattacaaccaattttaattcctcccttaaaagtagaagaacgggcttctacggattaccgttctttgcgtgatccttttgtgattcaagcaatgcattatattcgccaacgagcctgtcatggtattaaaacagagcaagtattggatcatttaaaaatttcccgttctaacttggaacaacgtttcaaattggaattaaacaaaaccgttcatcaaattatccatgaagaaaaacttaaccgagccgtgtatttacttcgctttaccgatatttctatgccagaaattgctgaaatatgcggttatccttctttgcaatatttttatgcagtaatgaagaaagcctatgggataaccccaaaggcttttcgtcgataaattactaaagcactaatgatttagttactgattgagtaaaatcagggttgaaaatctaaaaaaaatgagaataattgaaaactgtttttattttattagtaagctgtatgaaaatcgtttatttaagttttggttttatttttctcgcattaggtattcttggcattattatgccgggattaccgggttttccatttttactcttgactattttttgttttagtcgaagttcggagcgtgtgcataattggtttttgcagacagaaatataccaaaagcatgttctaccttttaacgaaaatagggggatgcgtaagaaaacaaaatacaatatcttaatttttgcgactattatgatggcaattgctttttactttacacccagtgcggttggcaaatcgatcattcttgttgccttagtcattaaatattggtatttcttatttaaaatcaaaaatttaaaaacgtaactgatcttgtttacgtgtttttgtataatgtctcaaataatttaaataagtaacaaaaatgcctttttatttccttcgtgtttatctgtttttattgctaaaaagtgcggtgctttttagtatgctttttttatctgcttgtaatgaaaaacaagaaaatattaagactgaagtttttcaacataaacagtctgagcaagttcagttgcaagaaatagaaaaaaagcaattaacacgaggtatttatgctgagttggtcgtagatcctttgttgctgaaagaagaaggacaggcagagattttgcgtgatattttcgaaggattaacaggctacaatacgcagggtaagattattccggcggttgcagaatattggcaaacggaagacaacaaaaactggatttttgtgttgcgtaaagatgcaaaatggtctaacggcgtcaaggtcatcgcacaagattttgtggatagttggcatagactggctttatctgataatccattgaagatttattttcgtctaatgaatgtcagtaatgcggaatcagttttaaataaaatgttaccggtagataaattgggggtttttgcatcaaatgaacgcttattacatattcaacttgataaaccgacaccacaattaccggcaatgttgacccatgctgttttattacctaaatatcaatcgacagataatgaatttataacaaatggtgcttatcaaattgctgaacgacaagaaaaacaaattgctttagcaaaaaatccttattatcgagaatcggaaaacgtttattttgatcgagttatttatcgagaaatttcccaaaatcaatcgattaactctttagatttcgttctgaatgcaaaatcatcgcaggaaaacttaatttatttgccccaattatgtgtttatttttatgagtttaatttttctcacccccatttgaaaaaaagtgcggttcgtagagcattaatttcaatggcaaccattccacaaacttttttttcagcgaaaatgcaagcaattcattcttttttgcctcattctttgcgattaggacaagaagacatttgggagccgactattgtggaaaaattattcgcagaaagccaaattacagaaaaatcgccgttaaaattcacgttaacttacgataaaacggaaatacaagaaaacattgcaagaaaatttattcaacattggtcgcaattagatttaattcatgtaagagcaaatccggtttcaagagaagaattactgcaacaacgggcaattggtgattttgatattattcgttcaggctggtgtgcggattataaggaaccgtcaagttttttgcttaattttcattctaagagtccggacaataaaacaggctaccaaaatcctcaagtagatcaattactggaaaaagcgttgcagtctttagaagaaaaagagcgtaatattttgtatatggaaataataaaaattttgcaacaagagcaagtggtattacctatttttcagcctcttatccccgtttggcaaaacaacattttgggtattgaacagaacaatgacagtggtgtgatatatagcaaagatttgtatcgacagaacaaagcaagcgaataagaatatcttatttccgcataaataacctatttaacttttaaacatattaaggaattattgtggcattagtgagtttaaccaatggctatctttcttttggtgatcagccgttattagattgtgcagaattacatattgaggcgggtgaacgagtttgtttagtcggtcgtaatggagcaggaaaatcgacattaatgaaaatattggcacaagacgtcatgatggatgatggacacttgcaatttgaacgagatttgattgtgtctcggttacctcaagatccgccaaactatgcagaaggcaatgtatttgattatgtagcggaaggtattggacatttagctgatttattaaaagattatcatcgtatttctctacgattagaaaaagaatacagtgaaacattgcttaatcaattagcacatattcaagctgaactggaacataccggcggttggcaatttgaaacaaaaattaaagaaattctaactaaattagatttgaatccagatactttattaaatgagctgtcagggggtggctacgcaaagttgcccttgccaaagcgttagtttgtaatccacatgttttattacttgatgagccgactaaccatttagatgttgacgcaattgaatggctcgaagaatttttattgacctttagtggcagtattatttttatttctcatgaccgctcttttattcgaaaaatggcgacacgtattgtggatttagatcgaggtaaattagtttcttatccgggcaattatgatttgtatttaacagccaaagaggaaaatttacgggttgaagcactaaaaaatgaactctttgacaaaaaattagcacaagaagaagtttggattagacaaggaattaaagctcgccgaactagaaatgaaggtcgtgtaagagcgttaaaagcattgcgtgaagaacgtcggcaacggagagaggtactgggcaaagctaaactacaattagataattcaagtcgctcaggaaagatcgtgtttgaattagaaaatgtttgttatgaggtagcagggaaaaccttgttaaaagatttcacaacgaccattttgcgtggagataaaattgctttagtcggtgtaaacgggtgtggtaagacaacgtttatcaagttgttgttgggagaaattaaaccaacgtccggaataattcgttgcggtacaaaattagaaattgcttattttgatcagtatcgtgccgatctcgatccggaaaaatcggttatggataatgtagctgatggcaaacaagatattgaagtgaatggtattaaacgccatgttttaggttatttgcaagatttcttatttccgcctaaacgtgctatgacacccgtaaaagcactttccggcggagagcgtaatcgcctgttgttagcaaaattattactcaaacccagtaatttattaattcttgatgaaccgacaaatgatttagacgtggaaacattggaattgttggaagaattattggcggattatcaaggaacgcttttaattgtcagtcatgatcgtcaatttattgataatacagcaacagaatgttatatgtttgagggaaatggcgttctgaataaatatgtgggcggtttttttgatgcaaaacaacagcaagctaattattttgcttgtaaagcagaggaacaagttaagcagaaaaaacatgaagaagagaaaagaggcgtaaattcagtcgttgagaaagcagaatacaaaactcgccaagttaaattatcctataaagagcggcttgaactggaacaattacctcagttgttggaagaattagaagaaaaaatcaccgcccttcaaacggaaattagtgatgtagatttctttcagcaaccgcatgaatatacatcaacaaaattacaaactttagcagatatggagcaagatttagagacggcttttttacgttgggaagaattggaagaaaaaaggagtttagccaattgaaattgggtttaaagggtaaaatttaaggttttgttatcaacaaaaaccgcactttttcagcaaatggtaaaaaaagtaagaaattgaagcgatgttttactaatccgaccactttaataaaaccctaaatttatttgttcatatatttcctttgctttagaattcgacaaattttaatgtcatcaaataaggaattgattgaaaaatgaacgtcaataaaaaaaaaatcgcttcttgctaaacctctaattgcatcagtattgtcgttatctgccgcttatgccaatgcggcagctttccaactcgccgaggtatccagttccggtttgggacgtgcttatgcaggtgaagcggcgattgctgataatgccgccgttgtagcgactaaccctgccttaatgagtttgtttaaagcaaatcaattttctataggtggggtttatgttcaatctagaattaatataaatggtgaagtaaatgttaatgtagggaagggagttgtacaagttgcagaggaaaaagcagatcagaaaaaagttgtacccggtgcattagttcccaatttgtattttgttgcacctattaatgacaaatttgctatcggtgcgggtatgaatgtcaactttggattacaaagcaaatataaaaaggattatgatgccggtgtttttggcggaactactgagctgaattccattaatttaaatttaagcggttcatatcgtatcagcaaaggattaagcattggagccggattaaatgcggtttatgctaaagcaaaaattgagcgtcatgcgggtgttctagataaggcaattgatactattgccgattataatggaatggttgggggtatcaaaattccttcattgcaagtgttagtcccaattttctccaagttaaaaaatggagtgaatacggatactctcttaacacaattacaagataataatgcatggggattcggttggaatatcggggcggtttatgaatttaatcaaggtaaccgtatcggtattgcctaccactctaaagtagatattaattttaaagatgatgatgccttgagttatcaatttgaagcagtaaatattatccctgttaaagagaaaggtgggttaacgctacatttgccggattatttcgaaatttccggtttccatcaattaacggcaaaattcgccatgcactacagctataaatatactaaatggagccgtttacaaagtttacatgccacttatgataacggtaaggttgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtgttgagttcggcagtatagatgcaaactataaatcaacagcacgtgccaatttgtacggcttaaatcttaactaccgtttctaacggttatccgattgtttattagttatagaaggcgtatttttgaatacgccttctatttttttgttcaaaacattacaaaatgttaggggctgtattagatcagccctaaattccacaccattttcgcaatgtttttaactgctcttttggtgttccaaagttaaaccgaaattcacattccttcaagaacaaaggaaagttttttcggtcaattccattatattttcggagtatccgtttggcttgactccaaaagttttctataccgttgatgtgattttctttcactgcaaacaactccgaatgattgatgcgttcgtggtgaaattggctcacatcaagagcatcatagctacgatatgtatcggtataaacccaactgtcaggcttgattttccttgtgattacaggcattatcgtttcggttttggtattttctaccaccaccgtaaatacctttccctgtcgttttaacaagccaaaaacagccactttaccggttgctccacgccctcgttttcctttacgatgaccaccaaaatagctttcatcaagctcaatctgtccatcaaaaacatcatcggcttcaagggctaaatgatagctgatgacttcacgaattttacgataaaacaaggcacttgaatttggattgatacctaaaatattagctgctgatcgagctgtcacttctaacacaaaaaactcaaggagctttttctgtatagatttctttaatttacaatgagttattttcatttttatagactggcatacttactaatctaatacagccccaaatgttaagtgaataattgtcaaggttcagtttactttcgatagttattttcccaaaatctccgcaaagacatgaatacctttaacgcccaatgcagttgctaacccaacgaaatttgcaccggcagttttcattcgttcaaaacctgctttgtcattaacaccacctacaccgataatttgtaggtcttttaatttaggttctttatccagcatttgacgcagagtatagacattacctaatgataatgcgtgaattgctgttcctgccagtcctccaatgcctgttcccgtttcagaatttaatatggattttccctcttgcatcactaatgaagagccaagcgtattagtagaagtaataaaggaaatcggtagcgttttattttctgttagcgattttaatagtccattaattaattcatcatattggttttgataggtaaatggtggaattttaatgccaatcggtaaagcctcttcccctagacttaacttggctaaagtggtttgtaacgcatttaaataaggtaataactcttctgcggcataggcaggcgaaatttctccgggcatattggggcaagaaatattgatttccattgctaagggcatcttcacttctgtttgtagcgtcacgatttgctcatagcattctcctacttcttcaggtgaaccaaacacggaaataatgaaaggcttgttggaagtggtttttaattcatcggagatagtacgaataaagcgaatggtagtcgctaaattattgggactaagtccaattgtatttaggctggtagtttgttgtggagtagcattgggggtattaacactggctgttttttgtgatgttgaatcaaataatacatattggttttttgtccagtcatgaggatagggaactagcatagacgtgcgagttgtaaccgcacctgtatattgacaagcataaagttcacgtaaattttctaattcggaacaccaagggcaaggggtatttaatagggcagggtgaatgttaagttttttcattttggttttctccataattagatcatagttaataaaaaaggacgctataaatagcgtcccggtaagttaagattaattcttttcagatgtaacaaattcaatagaatggtaactgaatcacaagatttgatgttttttaatgaaaatttatggatatatattaacatgttgctgatgcagaaaaaacattaccatagaaagagggttgaacgtggttgagaaagtcaatcttttatttatacaagatttctaaaccacgttattaaactggggcggtaatataacttatttcagcaaaaatgagaagctaatttagctatattttatctaaaaattttagggtattagaattcagtcaaaattttatcctttgaaagagggtaatatgttaaacatcgatagaaaatggaaaagtgcggtaacaataccaaatagaataaccagtagaatagtgacatttccgcctgcaaccataaatccttgtttaccattaggtaattgacgtgatttgtaagccaataatgcagggataatacaagcccaaattgttgccaccgcacctgcataaccgatagctttcaaaaaacctaatgggaaagcaactgataatattaatggaggaaggaaagttactgcccaagattttgttctccctattttgttgtcatcaaatttaaataagtcagccaagaagtcaaatacacctaaacctacaccaatgaaagaggatagaattgcagcaatggaaaaagcattaatagcttgtttaactgatgcagattcaattacatttcccaaagctttgagtaacacatctaaattgccatcactggcaataattggtgcaaattgatttcgtggcagattaccaaaaatggaaatgacccatagtaaataaagtgcaagggcaattattgttccgcctaaaatagctaatttggctttatgttcatttttatagtatgcacgcattgttgcaaccgagtggtgataaccgaatgatgttaatgcaacgggtaataaacccatagtatatattacataactattatctgagtcggtatttgtattaaataaaatggctaagtcaatatttttagttaagccaaatacactaagcataaaggaggttgccataaaaataattaatataacggaaatgcgatcgacaatgcgagtggaatgccaaacaaagaaagagaatatcaaaacgaagataattgaccaaactcgagagtcaatgttgaacatttcatttgttaatccacttaggatgccacctgatgctgtagtataagcgtatagtaaaatacctccaacaaaataaacggataaattgttgatgatgttgacagtattacctaataggcttttggtgactgtattaaaagaagctcgtaaatcaaaatgtttataagcctcaagtaataaccaaccggataacgtcatgcaagtcatcgtaaatccaatggtgaggacagaccaaatagtccaagctcccgcaccagatgtaggtaagcctaacattccggcaccgacacagacactcgcaataatgcaagcgccaccgaaaatagaaggtgatttttgcataatatagctccttttgaaaactataaaaaaacaccgcactttttgttaaaagtgcggtgccaaatttaaatctcttttaatcgagcggtgaaatgacgcagtactttaggttcataagtaaaatctaaccctttgatattttttgcattctctttcacttgtttgaatgcttcaatgatgaagtccatatgtgtttgagtgtaggtcgcacgaggaatagttaaacgtaacaattcagccgggcaaggtaattgttgacctgttttcggatctcgtcctaataggagagaaccgatttctacggatcgaatacctgctactttatataattcacaagcaagagcctgagctgggaattgttctgctgggatatgtggtaataatttgcctgcatccacaaaggcggcatgtccaccgggttgttgacaaacaacaccgatcttttctaaaccttgtacaaggtattcaatttggctaatacgataagctaaccaatcttgacgcataccatcacgtaaacctacagctaggcgttccattgcaccaccttctagaccaccataggtagggaaaccttcttgtacaacacaaagtgtacgacactcgttgtaaacatcttccattgaattatctttgaagcagagtagtcctccaataggtaccattgcatctttttttgcagacatagccaaggcatctgcatatttatagctttcgtaagtaatttgttcaatagtccaatctttgtattctgcttcacgttgttgaataaagtaggcattttcagcgaagcgagccgaatccataatcacaggaatatcatatttacgtgcaatttggtacatggctttcatattggcaagagataccggttgtccaccggcagaattacaggtaatagtacatacaatgtaaggaacattatttgctccaacttctaaaataccttgttccagtttttctaaatcaaaattacctttgaaatcatgatctacatctgtgtcaaaagcttcttttatatagacattacgtacagttgcaccatttaattgactatgaccttgagtagtgtcaaaaaaatagttagagaaaacaaccattttatttcgatccaaccctttttcttgctcacgttttttgatcaagacaggaatataaatttgttctgcaccacgaccttgatgggttggaattgtgtattcataaccaaagatttctttcactgcattggcaagagcatagtaactgcgacttccgctataagcttcatcacctcttagcatggcagcttgcatatcttgagtaacggcacctgtaccactatcagttaatagatcaataaaaatatcttcactgtctaataaaaatagattcatacctgcttttaagatagcttcatcacgataggcacgagttgtacgtttgacaggttcaataacacgaatacggaacggttctggtaaatgtttgaaattttccatgattaaatcctcaaataattgattaaaaaatgtatattacaaaaatattattaggattgaggagttatgggaaaatacagggatagctttggatctacaagtatccaaacttgatttggtgataaaacatttaccatagcttatccctttttagaaatgaaatgtaatttatctcagacgaggaagatagtaacttagcaattgcactttgtcatatagaatgttttaaatttgtgaactaagtcaaaaattttgataaaaaataagactctacttatagagtcttatttttatgaaagtgcggtttgtttccgcaaatttttattgtgtcgcttgaattgcagttaatgcaatagtatacacaatatcatcaaccaatgctccacgagataggtcattgaccggcttacgcataccttgtaacatcggaccaatagagattaaatctgctgagcgttgtactgctttataggttgtatttccggtgttgagatctgggaagacaaatactgtcgctttaccggcaaccggagaatttggtgctttagattttgctacatcttccattactgccgcatcatattgtaatgggccatctattaataaatccgggcgtttttcttgggcaatacgagttgcttcttttactttctcaacatcagcaccggaacctgacgtgcctgttgagtaagagatcatcgccacttttggatcaataccgaatgcttttgcggaatcagcagattgaattgcaatctctgccaattgttcggcagttggatcaggattaactgcacagtcaccataaacaagcacttgatcaggtaataacataaagaagattgaagaaacaattgagttaccaggtgctgttttaatgatttgcatcggtggacgaatagtattcgctgttgtatgtatcgcacctgaaacaagtccatcgacttcgttagcctcaagcatcatagtgcctaatacgacggtatcttctaattgctctcgtgcagacgtttcagtcatacctttggctttacgtaattctactaaacggtctacataattttcacgtacagagacaggatcaattattgtaataccttttcctaatacaacgccttgagcatcagcaacacgtttaacatcatcaggatttgctaataagatacattctgcaataccacgttctgcacaaagactagcagctttaactgtacgaggttcatctccctcaggtaatactattcgttttttggctgcacgagctaactcagttaattgaaaacggaatgcaggaggagataaacgacgaggacgagttgaggcggcaactaaattttcaataaatgaagatttaaattgttggcttgtgtattgtttaatgttttcgatgcgttctttatcatcaacaggtacttcaaggttgaagctttgtagagccaatgcactttgccatgtattaccttcaattcgaaaaataggtaagccggtattttcaaatactggttggcatagttttttaatttgattgtcaattttgtaaccacctgtgagtaaaataccacctagctcgatcccgttagtcgcagcaagtgcggaggcggttaggacatcaggacgatcagcggaggtaactaacagactacctgttttgaaatgctcaaccatattttgtaatgaacgagcacagaaagtaatactacgaatacgacgagttttaatatcaccctcatgtagaatagaagcacctaaatgattgaccaaatcaatagcacgagttgcaataagctccgcattccacggaacgcaagctaatactttaatagggcttttttcaaatagcttgtaaacctcattaaggttattttgtttatgttggtaagcatcaaaaatttcacttaggtctggacgagtacgtccggattcatcaattggggcattaaatttattaattatgacaccaagtaagtttggattattttttccgccaaattgggaggccgctgcttcaatgcgttcttttaactctgccggcgtttctgttgcaggtgctgcaactaatacgatttcagcatctaacgcctttgcaatttcgtagttgatactgtttgcatagccatgcttgcgagttggaactaagccttcaacaataatcaattcattatttttagctagttgttgatgattttcaacaatcttttccagtaacacatcggattgattttgaccgattagattttcagccacacttagcataaacggttcggctgtttcaagtgttgtactggtacgcacaattgaagtagtgcggtctaatttatcttcatcggtacttggttgcgaaattggcttcatgaaaccgatttttgcccctttttgttcaagagcgtggattaaacctaaacttacactggttaaaccaacaccggtgctaataggaataaggatgattgtacgagacataaaaaaaccttaaataatgttgttaaaaaagaaactgccgaatttatcggcagcctatagattacaattagaaacttaaacgagcagtatcttgtgcaattacaagttcttcgtttgttggaataacgattgcgattggcgtattatccgctgtaataacaccttcattaccaaaacgagctgctgagtttttctcatcgtcaattttataaccaaatagttttaaatgatttaaagtaatttgacgaaccaaggcggcgttttcaccaataccgccggtaaagacaatcgcatctaagttttcgccaataatagccatgtatgaaccgatatattttgctaaacgatagcagaatacatctaatgcacgttttgcagcactttctttttcatagttatcttcagaataacggcaatcactcgttacttctgttaaacctaacaaacctgattttttaactaaagtttcctcaatctgagctactgacatgcctaacgtattgtgcatgtaaaaaatgattgctggatcaagatcaccggaacgagtacccatcaccaagccttccagtggagtaaagcccatggaagtatcaatacatttaccttggcgaattgcagcaacagaggcaccgttgcctagatgacaggtaattacgtttattttatcttcagcaatatttaaacgtttggcagcttcacgactcacgaaatagtggctggttccatgcataccataacggcgaacgccatgttctttgtataaagaatatggcagagcgtataagaaagcttcttctggcattgtttgatggaaggctgtatcaaatacggctacgttgttatcttttaaatgaggaaatgctttaaatgcttcttcgataccgatcaaatgtgcagggttatgaagaggagcaaattcagcagcatctttaatgccttggataacttcatcggtaataacaacagatttggtatatttttcacctccatgaacaacacggtgtccaatggctgcgattgaatttttaagatcttcagttaagatagttgaaacgataaagtttaatgcttcactatgtgctgcaccggcacctaaatctgcattacctttctcaccattaagtttccacttaattcgggcatccggtaggtagaacgcctcggccaaacctgataatttttcagcacctgaaactggatcaagaatagcaaattttaaagatgaactaccgcagttaagaattaggactaatttttgagacatacgagacctattttgaaagttaagttaaaaaataaattcatttactcaacaatattccaagtaaatgaactgacatgaaagtctttgccctgcatagaatatacttttcagataataaaataaattggtaaaattaaaaaatacgacttttatcaaaaaatgtatcaaactcatcgtttaattttcttgataaaaatgatagatttttttataaataattctaaacgaatatgtatcaaacactaaaattaggtcaacgttatttggaaacttggccttcaatacctaaactgagtattatttttcctgaaaatcgagttattaaggtaacattatttgcacaaaaatttatgccgtttttagcagtattttcattagtttggcaacaagtttatataaaacatgatctggttgctttagctattgcagttttaaccgctttgtttgcgttgagcttgccattacaaggtctatattggctaggtaaacgatcaaagttgcctttacctccacaaacaaaggtatggtttgataagatagttgaggtgttacagcaaaaaaatactaatcttgtttctattgagcaaccaacgtatcaggatttggcagggttattgcgtaaagctgaacagaaattagatactgagttttggcagagtatttgaacgaagttcatcgctaaacagcaagtgatacatctaatggggtaaatatagtaaaattttccccgcacttgggtatcaagtagcttattttttcactagataaggaaagaaaatgctttgtgctatttacaagactaaaagaaaagaagggatgtatctttatattgaaaaacgggggcattttgattccgttccatcttccttacttgagtcattcggcaagccaatttttgtgatgttatttaatttagcaggacaaaaatcattgattaatgctaataatgaagatgtgcaacaacaaattaaacaaaatggattttatttgcagatgccaaaacagcaagaaaatttacttgaacaagaaagacagtatcttaagcacaataaatgacataatcaatgatatgattttttaaaatttttaccgcactttgacacttttgaaaaaataaaggcgatcatagatcgccttaaatgtataaattatgctacacagaccgtttcggttggtcaaataccgtcactttcggtgcggcttctgtgtatttttccacttgaacaatacatgtattcggggaattaccttgtgctaattttgaagtaccttcatcacgtgtcagtacgttggcacaaccatttttacataaaggttgttctgattgacctaaatcagccggatcataccaagccccctcatgtaatgcgaccgtacctttaataattccttcagtaactaccgcacctgccaatacttgtcctcttttgttgaaaatacgaacaatatcaccatccatgatgccacgagccattgcatcttctttatgaattaacacaggttcacgatcgtttactgcatattttttccgtaacgatgtgtgagccaattgactgtgtaagcgatagtaaggatgtggtgtaactaatgctaaaggggcttccgtcgttgtattacctgcaaattcttcaggaacaaaccaatatggatgacctttacaatcatcataattcatttttgcgacaacatcagagtaaatttcaatttttcctgatggtgtaccaagtggattcagtaaaggatcattgcggaatgcttcgtaacgtacccatttttttgatttttcagttggtttaaagttaacaggtttattttcttgccagaatttttcaaatttcggcataagtacacgatttttacgtgctgcattaaatgccacgttgtaaaaatcttgcaaccattccatttccgtttttccttcagtaaatttgtcttctactcctgcacgtttggctaattctgcaaaaatatcatagtcatttttcgcttcaaattgtggaggaacaacttgtttcattggaaaaatattcatcatggcataatcaccggacatagttaagtcgttacgttcatagctcgttgtggctggtaatacaatatccgccatgcgagcagtcggtgtccagttaacttcattgacaataacagtttcaggtttttgccatgctttcactaatgtatttgtatcttggtgatgaacgaaaggattaccacccgcccaataaattaacttaatgtcaggataggtcactttagagccattataatcaattgtttttccgggattcagcaatacatcagcaatacgtgctaatgggaaagagaattttgatgtatcatcaagccatgttttttctccggcttgtagtgatggattagctgtaattgaaccaataataccaccgactgcggaaggtgcaccaccattagaataatgataactgaaaccaaatccgcctccaggtaacccaatttgtcccagcatcgccgctaaagtaactaatgtccagtgagtttgttcaccatggcgttgacgttgcataccccaaccgcccattaacatagtacgttttgacgaaaaatcagcagctaactgtttgatgatatctgcaggtaatccacaaattttgcttgcccaatttgcgtctttcggttgaccgtcagtttttcctaataaatattgttcaaatttatcatagccagtagtgtattttttcaagaatgccttatcatgtttatctgtagtaaccaacgtatgtgcaatccccaacattaaaggaacatcggtgcctgtatgcacaggtaaccattctgcatttaagaattcacagctttcacttctaactggatcaatacaaataatacgtttaccgctttctttcaattttttgaaatactcaataccttgttgatcggtggaagtccatgcaattcgcaaagtcgtaagaggattggcagcccataaaacaacaatatctgaattttctaaaacggtttcccagctggtttgttgttcataaacttcaattgtacctaatacatgaggcataattacttgtgccgcacctgttgaatagtcccctttgactccgacaaatccaccggtaacattcatgtaacgctgtaacaaagtacggctagcatgtaatgcacctgagctataccaaccataagaaccggcaaaaataccgcctgcaccataagcatcacgaacacgtttcatttcacctgcaactaactcaaaggctttatcccaagaaacacgaacccattcatcacgtccacgcaaactggtatctttattaccctccaaaaatcctttacgaaccattggatattttacccttgtttcactataaagttggtcagctactacgctttgtaattcattttcgactgaaattggcattgcagatcctgatttaactaccttgccattttctacaactacacctaaagccccccaatgagcagctgttacaacggtatgttgttcagccgcaacagctttcgaagctaatgttccgacaacaccgccacttagagatacgccagccacgcctaatgatgaattttttaaaaaatcacggcgacttgtattaactttattttgtgttttcattttaaacctcgttatttactaggctcacaatgaactggtgaaagaaaagacatcgaaacggttagaaaacacaccgcactttctccaacacattgtgaaagttttattttcgacacctttctaaagggagtggcacaaccatttctagttataccatgtgcaacatttgacaatgttacaggcttgcaaccttattttgcaacttaggtcaacaagctcggagtcgtcagttttttcaaaaatttcagcgtttcctttaagcgtagcttaatggcttttttcgccaaaatctttggcattgcgttgtaaatagattgttacagatcgtacgtcatctgctgtcattgatgtacgatctttcatcgaatttacaacaccaatccattgatttgcagtgtaatgatctgccccaattggtgcatgacaaccactacaatgagtttgatttaaattatttccaaactgatttaatgcctctaaattagacgttagtgcattttttgccacgtttatttcaaacgtaacctctttccactcagaatctgtgactttgtcatgaacagtttgcaacacgttcacatttttctcaattccatcacctaaagccaacataatgcgttgccctaattgtgcatagactattgtttccgcccctacttgttgccaaccgtgaattgtgccgataacattgtcatcttgcaatttccaatcattcacttctgcaaacggcattaaccgcacttcatcgccttgtgccagctgtgccggactcattgccaaactatataatattttatcggtttgcttaaattctcctgcatgtttagttaattcaccatatgcggctgtatcatcaacctctatttcaggcataaaatgagcaatacctttatggcaatcaatacaagtttgatttgtttcgatgccggttttgtgcattttttgtgctgtcggtgtttgcgaagacatttccattgcttcgaaactatgacaactgcgacaagtggcagaatctgattcttttaaatcttgccaaacggacttcgccatttctaaacgatgcttttcaaatgcttcttcatcaggcaatttatcagtaacataagtatgccaaagatctttcactgcaaagacttttgttttcacataatggaaaacgttatcttgcgggatatggcaatccgcacattcggcacgaatcccttttcggttagagaaatgtatagaggcttcccattctgcttgaggttgttgcattgaatggcaagaaacgcaaaattcagtggtactggttgctttcattgcatactgtactcccgctaaaataatcacccctaataacacaccaacgattccactaaacagccattttttatttgattttgccattcgcttttcccccaaaaataaaattcaataaatcaattacaacaaaaaaatcatactcttatattgtaacgatatgatgttggtaattcactaggcacacacgaaaaataacggctatttgcaccgctcttgacgtagatcaatatttaaatttaagagtgaatatgtgaaataaaatgcgtaattttatgtggcatttttagtattttcacccataaattgaaaggattgatatggtacaattttgttttttatcttatgcagaggaaaaggataggttcttttttgtgccactattaaagttaaaggagaaaagcaatcttgttgttttttttcactcaaattgacttgatcgagtatttcaaaatttaataattttatccaatcaaggatacgccaagtgaaatattgtttaaagggaagtgcggtttgatttttatgatttaaattttgtttgaaaatcaatgggctataagggttaaataaggaaataaagagataaccgtcattttctaaaaccctggctatttcacctaataattgatgggaatgttgcgtgaagtttaatgtattggctaatacgcaagcgtgaatagattgttgtacaaaaggaagttgtaatggatcagcttgtatcagactaatttcttctgttacgttttgattagctggaaaaagtgcggtaggatttttcgtcatttccggcatgaggattattttgtggcgtaaaggtaaattgagttctaattcagcacttaatccgccaatcatgagccactgatcgcccaagacttttggaaaccaatctgcaaaaaaatcattgattaggctacaatacgttgttcctttttggatatgttgccaactcatcggcaatcgataattttttactgattttatgttgaatttcatattttctaacttgataccctttggaggagcttgatgttaattcctattcctgcacttaatgataactatatttgggtgtataaacgagagaatttatctgtaattgtgatcgatataccggaaatagctgcattatctcaatttatacaggcacaaaatttagtgattggagctttgctgatcacacataaccatagggatcatattggtgctttggctgaatttaagcagttttatcctcatgttcatatttatggtccggcagaatgtgccgatcaaggggtgacacaagtcattgatgcaggaaggttaattattgatgaatatcatatagatgtattaccgaccggcgggcatacggcacagcatcttagttttttggtagatggtcatttattttgtggagatactttattttctgctggttgcgggcgtgtttttacgggagactattcgcaaatgtttacttctttacagttactcaaatccttgccggatgaaacaatagtttgcccagctcatgaatatacgttaggcaatttagcgtttgctttaactacaggcaaaaataaaagtgcggttcaaaagcaacttgaaaaagtaaaaaaactaagagcagaaaataatcccagtttgccgacaacattagcattagaaaaacaaattaacccatttttgcaagttgagggccttgaggaatttattgagttgcgtaaagcaaaagatatgttttaacctaaattagcaattctattgtattgatagacaatcgaatttgctcaatgtgagacaatttattagaatagcgacgttttttacatgaatttcccaacaataaattatttatgaccattcttgttctcggtattaatcataaaactgcgtctgttgcactacgagagaaagttgctttttctgacgaaaagcgtttgttggcattgaagcaaattaaacaaactcagctggcagaatgtgcggtgattttatcaacttgcaatcgaacggaagtgtatttacataataaaaatgttggacctcaaaatgatgaagtctggttagatagttgtgttcaatggtttgcagatattcatcaagtagatttagaagaactgaaaagttgtttatatagtcagcagaatttacaagcatctcgtcatttaatgcgggttgcttccggtttagattctttgattctcggggagccacaaattttaggtcaagtaaaacaggcctatcaaatgagtgaagagtattattcactgcattctgatattggcatgatgagtactgagttatctcgcttatttcaaaaaacttttgctacggcaaaacgagttcgtactgaaactcatattggagaaagtgcggtatcggttgcttatgcagcctgtagtttagctcgtcaaatttttgatagcttacgcaatttgaatattttgcttgtgggtgccggagaaaccattgaattagtcagccgtcatttattgcgtcatggagtgaacggcttagctattgctaaccgtacgttatctcgtgcggaaaaattggtggaaaaactagaaacaacacaaaagatagatatttttagtttagacagactttcggaagggttaaagagagcagatattgttattacctctaccggcagtcctcatgttttaatctcccgaaacttgattgaacaggcacagcaaatgcgtcattacaaaccaatgctgattgttgatattgcggttcctcgtgatgtggaggaaagtgcgggggaaattgaatctgtatatcattacactgtagatgatctacataatattattcaacataacatcaaccaacgtgaacaagcttctcaacaagctgaacatattattcagcaagaaagtgcagatttctttgaatggcttaaagtacatcaattttctaatttgattcgcaattatcgagaaagcgcggagataattagacaagatttactcgaaaaagccttgcaggctctgcaaaatggtgagaatacagagcaagttttacaagagttgagtcataaactgactaagaagctgatccatcaacctactcaagctatgcaaacgatggtaaaagccggtaatacagaaggtttacaggctttttctcatgcagttaagtcctaggaaagtacaatttatttaagtttatccagttttgccaataaaataggtgctggttgttgttgaattttatacatacgccaaagcagtaaaatagcagcgattgttaaactcactacaaaagatacccaaaagccggcagcaccgatacttggaataatccagtcggttcttgataaggaaaatcctaacggcatgccaatgccccaataacaaaaaagggtaatgtataaaatagcttgtgtatctttatatccccgtaatgcaccactggaaactacttgagctgtatccgaaaattgataaagtgcgacgagcatcagcagactacttgatatagcaatcacttctttatcatttacaaaaattgctgctatttcatagcggaagaaaaagatgatggatgccgtcaggaaagcaatagataaacctacagtaagagcagagaaagatatctgcttggcattatctattttgccttcgcctagacgttgaccaacaagaatagtagtagccatacctaaagacataggtaacataaatgcaaaggagctggtatttagtgcaatttgatggcttgctacaacttgagtaccgagaggtgataataatagtgaggtaagtgcaaataatgccacttcacaacataaagaaaccgcaataggcaatcctaaacgaaataattttgccaaagttttcgtatcaggtttttcaaataaatgttcaaaaaccttgagatcacgttgatttctagcatgcttactatagacgatcatcattaagcacattatccagttgacaatagctgttgcaatgccacaaccaaccgctccaaacgccggaatacctaatttgccgtaaataaaaatatagtttagagggatattgcatagtaagccaaaaaatgtaatcaccatagccggttttgttttggcaatgccgtcatttaagcaacggaagttaattaataataaataaccaggtaatccccataacattgcacgcaaataaccgatggtaatattggcaagtttttcttccattttcatatattgaatgacaaaatcgctattgtagattaataagccaagaggaatacagctaataaaaacaatccataagccttggcgtatttgatgagcaatatgatctcgttgtccggaaccatttaaataagagattgttggaggcaaggcaagtaataagccatgtccaaataatactaggggtaaccaaatagatgccccaactgcaacggcagccatatctgctgcactaacacgtccagccattattgtatctactaaccccatggaattttgtgctacttgtgcaagtaaaataggggtagcgatggcaattaattttttagcttctgtgtgatattgttgaaaacgagttaatttcataaaaatccgattttgctataatattggaaatatttatttagagagaactttatatgtttacaggaattgtccaaggaacagcacaaattcagtctattattgagaaagctaattttagaacacaggtaattaaaatgccacaggatttattagcaaatttagaaattggtgcatctattgcaaataatggtgtttgtttaacggttacagaaattaagggtgatttgattagcttcgacttaatggcggaaacattacgtattacaaatttaggtaatttagcggtaggcgattttgttaatgttgaacgtgcaatgaaaatgggggatgaaattggcgggcatattttatccggtcatgtttattgcactgcaacaatccaaaatcgtattcaagcagagaataatttgcaaatttggtttgaaatgcctacagctgaattaatgaaatatgtgttaactaaaggatttattgctattgatggaattagtttaaccgttggcgaagtcaaagggcagtgcttttgtgtgaatttaattcctgaaacaattaaccgcactgtgattgcaaaatatgatataggtgatttagtcaatattgaaatagattctcaaacacaggcggttgtggacacagtagaacgatacttggcaaacagataaattcattttgcctaaaatctaaaattgtgggagtgtactctcacaattgtatctatttatagcgtttttttgtgctttgctcatctaaattatgcaatcgtgctaatttttctttaagttgaatttccagtccacgatctgtaggaaaataaaatttcgtatcttttaattcttttggaaaataattttctcctgccgcataggcattaggttcatcatgagcataacgatattctgctccatatcccaactctttcattaaatgagttggtgcattacgcaaatgtaccggtacatcataatccggcatttcttttgcgagtttttttgcttgtttaaaggcaacatatacagcgttacttttaggtgcaacagctaaatatacaatcgcttgtgcgatagcacgttctccttcagctgcaccaactcgagtaaaacaatcccatgctgcaagtgctacttgcattgctctcggatcggcattgcctacgtcttcggaggcaatagctaataaacgccttgcaacatagagaggatcacctccggcagtaataattctagcataccaatataaagcagcatcgggagcggagccacgaatagatttatgtagagcggaaattagatcataaaatcgatccccttgcttgtcgaagcgagcctgtcgttcccctaatacttcagttaggagacgatgattaatcaatttccctttttctgtttcatctgccatatccaccatgagttctaaacaatttagtgctaaacgggcatccccattgacatattcagctaaggtttcaagaacattttcagcgaaaatcaaccgctcttttcccaatccttgctctgcatcttggatggcattttgtaacactgtcacaatattagatgtagttaaaggtttcaaaatataaactttgacacgagagagtaacgcattatttaattcaaatgatggattttctgtggttgcacctataaaaatgatagtgccgttttcaatatgaggcaaaaaagcatcttgttgggttttattaaaacggtgaacttcatcaacaaataaaatagtttgttgacccattaaacggttttgttttgcccgttcaatactttcccgaatctctttcactccggcggtaactgcagaaatacgctcaacttgggcatgaatttgttgtgcaataatctctgccagcgttgtttttcctgtaccaggcgggccccaaaaaatcatagaatgaatatgtccgttttcaatggctttatatagtggctttccagctccgattaaatgttcttggccacaatattgcttcagtgtttgcggtctcatttttgcggctaagggttgaaatgccgagtgagagaaatcaagtgaaaaagtggacatataaaactccattaaatgattaaaagtggacgtttattacgtccaatcatttcaattttaattaattattttttacgttgatcgtcaaattcaacgcccttaggcaaggtaaatgtgaatattgcatcatttaaggctggattggtaatcttacgcagaatatacaagttactttgcccatctttctctattgtactaaaattttttaatacaccatctttttcaattcgaatattaaattgcttgatggtacttttcttagattttggtttaataataaacgtatcggatttttgctcaacaatatattgttgccaatgacttggattattacttgttagcaaaacaaagggggtatcgcttaaggtatcttcaacccaatttgctgttacttgctcaacaaaaggatcgtagaaccataatgtttttccatctgcaataatttgactttcttgaggtgtttcattgtccatacgaaataaattaggacgtttgagttgtatttttccactaccttgctgtattttttttccctgtgcatcagtcacttgttgtgtatagtcagcacttaacacatcaattttatttaaacgattttgtaactcattaaccgcatttgcccaagttacattactgatacctactaataaaagtgcggttaaatttagatattttttcattatttgtccttttcaattgaaaatgaattgattcgatataatcaaaaggctgaaatgttgtataacatatcataaaagataagtataacccctaaaaaataaataatattccgttcagtttatgatactgtgatctagtgcaaagaaaaatttttttcgctagctataatacaacttggtagtttaacagtttatttgaggagtatttcttatgcaaaattgggcacctgaggtatggcaaagtgcattaattggtttatgtattggagtttttatcggttacttattattgcgtttcactaaaggaacggtcaaaaaacagataaaaacagaggctgagttggagcaagtgaaaattcaacttaacaatcagaaacgacaattagagcaacattttgctgaaagtgcagagttgttaaaaaatattgcacaggattatcaaaaactttatttacatttagctaattcatctacaacactattgcctgaattggcacagaaagaattattttcaccgcatttattagccacggaatctatttcgtcacaacaagataaatcaaaagataatcagcctagagattattctgagggttcatcaggtattcttaaagctgaaaaataactatttctaaataggcacattgaggtgcctattttgctgtttttctttaatctctttgaatttctgaaacttttttgtattttttctgtcttaaattagcgatatgtatgatttaaatggagaaaaaagtgaaaaaatctagctttgttttaaccggtattgctttagggttaagtgttctaacaacatcaattaatgttcaagcaagtttgcctatggcagttgatgaacaatctcttccaagcttagcaccaatgttacaaaaagttttacccgcagtggtttctattgcggtagaagggaaacaaaaaaataatttttctttcaataatgaaattcctgaagagtttcgccgtttttttggtgacagctttggttttgaaggatttagcagtcgtgcaccgcggagttttcgtggtattggatctggagtgattattgatgcagaaaaaggttatgtattgacaaataatcacgtgattgatcaggctgataaaatcacggtcaaattagaagatgggcgtgaattcaaggcaaaggttcttggcaaggatgatatgtcggatattgcacttattcaattagaaaatcctaaaaatctgaccgcagttaagatcgctgattctgataaattaagagttggggattttacagttgctatcggtaatccattcggtttggggcaaaccgcaacatcgggaattgtttcggcattagggcgttcaacaggatttgatagcggagcttatgagaactatattcaaactgatgctgctgtaaatagaggtaattccggaggaccattagtaaatttaaatggtgagcttatagggattaatactgctattatttctccaagtggcggaaatgcgggaattgcatttgcgattccaagtaatatggcaatcagtttagttaagcaaattattgaatttggcgaagttcgtcgaggattactcggtattaaaggaggtgaattgaatgccaacttagcaaaagaattcaatattgatgtacaacaaggtgcgtttgtgagtgaagtattgccaaattcagcggcagaaaaagccggacttcaagcgggtgatgtgatcacggcaattgatggacaaaaactggcaagttttgcggagttgcgtgcaaaaattgcaacaagtggtgccggtaaagaaattaaattgacctatttacgtgacggtaaatcgaaaactgcgaaagtgaaattgcaatctgatgatggagatacaatttctgcagttggtaacatttctatattagaaggtgcggaattaagtaattataatcaaaaaggcacaaaaggcgttgaaattaaagaagttaaatcaagatctcttgctgctcaatatggtttagaaaaaggcgatattattattggagtgaaccgccataaagtagaaaatttatctgatttacgtaaaattttaggcaaaaaaccttcagctattgccttgaacattttacgagatgacagtcgtttttatttattaatccaataattttactgaacctataattcttattaagacaaaacgaaatccgcactttaaagattgaccgatcaaagtgcggattttttgtgtttaaagatgatgttcttgtctaatttttttgagtaactcatcgcagcatttatccagtaattgataagtctgctgaaaattgccggtataccaaggatctggaatatgatcacaagctaaatcttcacatatcgtggttatttgaaaaagtttagatggtgctttcgtaaagaatttttctaaatcatgtagattgttgttatccattgcgattaaataatcaaattgttgccaatcactattgcgaatttttcggctggtaaaccctctgttatcaatagcatattgggtaagaatctttgccgtttcttggtgcatattttctccatcatgccaaccggaagttccggcactatctgtaaaaatttgattatctaaatgagctaatcgaattttttcacgcataatatattctgccattggggagcgacagatattacctaaacagacaaataaaattttaatttgtggtttcatgttaagcctttgccttatgatgaataaaagtgcggttgtaattgtacatgttttgtgccaatttagataagtttttattagcaataatctatggtaatattcgcttcccctttattttaaaagtgactaatcatgtctttaccaaaatatgttgaacaactgttaaaagagaaaagtaatgttcgggtattctcgtttaaatatgatgggaaatcttattggctaaaacaaaccgaaaaactttcttttatttggcggttcttgaaatccaatccagcggaaatgttaaaaagtgaaattattcgcttacaagaacttaataaaaaatcagcacctgtacctaagttagttttatttggtgataacttttttgtgactgaagatgtgggaagtagtgcaaatacttgggttgaaaatgaggatttatctattgaattaagaaataaggttttgtttgattgtgctcaagcattggcaagtttacataaacaaaatattactcatggtcgcccagccttgagagacatgatttggtgtgaagaaaaagttatttttgttgattttgaatgtacctcgtcaagtaataacatagattggcaaaaaattcgtgatggattagtttttattcatagcttaggacgttcttcaactgtttcggatgagcaaatagcattgactgttactcattatcgtcagtattgtgatgctgatatttggcagaaaactgctgatttcatctataaatatcgttgggcatattatgttcttcgtattttcaaacctgttgcaagaatggatttaattgctatttatcgtttattcgaagctattttaaaaaatcaggaaacattatgataaaaaaaagtgattgtttggagtatttgtgcggtttggtaatggcagtttaagtgttaggggcataataatagtattcgactttttattaaattgtttataacatcaacaaataacaataaattagtaattttatcttgctattttttttatgacagatataatgtgtcgcatatttcggacgcggggtggagcagcttggtagctcgtcgggctcataacccgaaggtcgttggttcaaatccagcccccgcaaccactttacatagaagttttcgtaaaggaccccactgtgacttggggtttttttatgcgagtaaacttgagatttagtaaacgggctgatagccctttttttacatctgtttgttatgaaatgtagaaaaaaactcaatcttacgtgctattttgagaggagaggatagtggcaacattagaggataaattacaagaattattacaaccttcagtagaggatttaggttgtgagctttggggtattgaatgccaacgttccggacgtttttttacagtacgtttatatattgataaaaaagatggcggtgtaacggttgatgattgtgctgatgtcagtcgtcaagtaagtgcggtgctggatgtggaagatcctattgcggataaatataatttggaagtgtcttcgccaggcttaaatcgaccattgtttacattaaaacaatttgagaattatatcggacaggatatttctgttcatttacgtgttcctatgtttgaccgtcgtaaatggcaaggtaagttagagaaaattgaaaatgatatgctgactttgattgttgataaccagccacaagtattagtttttggcaatattcaaaaagccaatgttgttcccaaattcaattaattagagagacaaaaatgagtaaagaaattttattagccgctgaagcggtttccaatgaaaaattgttaccccgtgagaaaatttttgaagcattggaaagtgcaattgcactttcgacgaagaaaaaatatgaacaagaaattgatgttcgtgtagtcatcaatactaaaaccggtgagttttctacgtttcgtcgttggttagtggttgaaacagtactcaatccaacgaaagagattacattagaagcagctcaatttgaagatccggaaataaaattaggtgactatattgaagatgaaattgattcgattgcttttgatcgcattgcgatgcaaacagcacgtcaagtaattagtaccaaaattcgtgaagcagagcgtaataaaattgtggaacagttccgttcacaggaaggtgaaattgtttccggtacagtgaaaaaagtaaatcgtgattctattattttagatttaagtcaacaggctgaagctgttattttgcgtgaagatatgttaccgcgtgaaaatttccgtccgggtgatagagttcgtggtgtactatacaaagtaagtccggaaaacaagggtattcaattgtttgtgactcgtgctaagcctgaaatgttagtggaattgttccgtattgaagttcctgaaatcggcgaagagttgattgaaattaaaggtgcctcacgtgatccgggattacgtgcaaaaattgctgtcaaaagcaatgataagcgaattgatccagttggagcttgtgtcggtatgcgtggctctcgagttcaagcaattaccaatgaattggggggggagcgtgtagatattgtgttatgggatgataatcctgcacaatttgtaattaatgcaatggcaccggcagatgtgagctcaattgttgttgatgaagataatcattctatggatattgccgttgaaccggaaaatttagcacaagctattggacgcaatggtcaaaatgtacgtttagcaacacagttaactggttgggtcttaaatgttatgacaatagatgatttaaatgctaaacaccaagcggaagataacaagattttagctttatttatgaccgcactagagattgatgaggagtttgctcatatccttgttgatgaaggattcactaatttggaagagattgcttatgttgctgtaaacgaattaacggcaattgatggcttagaagatgaggatcttgttgaggaattacaagctcgagcgaaaaatgcgattactgcaaggatgttagctgaagaagaagcattgaaacaagctcaggttgaagaaaaattattaaatttagaaggtatgtctcgtcatattgcatttagattatcagaaaaacaaattacaactcttgaagaattagctgaacaaggtgttgatgatttatcagatattgaagaattaagtgctgaacaagctgcagatttaattatggctgcacgtaatatttgttggttcaattaggaataaagagtaataagattatggcagatgaaataaaaaaagaaaatgcacccaaaaagttgagtattcaacgtcgaacaaaaactacagtgagtggaacaagtacaacgggaaaaagtaaagaggttcaggttgaggtgcgtaaaaagcgtacagttactaccgatcttgaacgtaaagctcaagaacaagccaaattaaaagccaaagaggaagcagagaaaagagctgctgaggaaaagcttgctgaaaaagcgaagcgagaagcggaaaaagctaaagctgagcaaataaagatagagaaagctaaggctgaacaagctaaagcaagtaagaaaaacgttgatgtagaaaaagaaaaacgtcgagcggaagaggctgaattacgtcgtaaagccgatgaattggctcgtcaaaaggcagaagaaaaagcacaaaaagcggctgaagaagctaaacgttacgctgattttgatgatagtgacaatgataacggtaagttggatgattatagcgattatcacttaacttccagctatgcacttgaggcagaaaatgaagaagaacgtcgtaatgaaaatcgcggacgtagtaaaaataaagtagttaaagctaagaaaggtggacgagatgatgaaaatggtaataaaaatgaacgtcaatcagatcgccgtaaccaaaaagatgtaaaaggtaagggaaagcacgctaaaaaagccagtgcgttacagcaagcatttactaaacctgctcaagttgctaaagctgacgtagtgattggtgaaactattactgtggctgagcttgcagcaaaaatggcagttaaggcaacagaaattatcaaaaccatgatgaaaatgggagaaatggtaacgatcaatcaagtgatcgatcaagatactgcacagcttgtggctgaggaaatgggacacaaagttattctacgaaaagagaatgaacttgaagaaatggtcatggaggatcgtgatgtaaatgctgaaaaagttcatcgtgcaccggtggttactattatgggacacgttgaccatggtaaaacttcattacttgattatatccgtaaagcaaaagttgctgcaggtgaagcgggaggtattactcagcatattggtgcttatcatgttgaaactaatgatggcaaaatgatcacgtttttggatacgccggggcatgctgcatttacttctatgcgtgctcgtggtgcgaaagcaacggacatagttgttttggtagttgcggcagatgatggtgtgatgcctcaaactattgaagcgatccaacatgctaaagccgccaatgcaccattggtggtcgctgtaaacaaaattgataagccagaagcaaaccctgatcgagtagagcaagaattactgcaacacgaagtgatttcagagaaatttggtggagatgttcaatttgttccggtttctgcgaaaaaaggcttaggtattgatgatttattggaagcaattttgctccaatcagaagtcttagaattaaccgccgttaaagatggcatggcaagcggtgttgtcattgaatcttatttggataaaggtcgtggtccagtagcaactattttagttcaatccggtacattaaaccgtggtgacattgtactgtgtggttttgaatatggtcgtgtgcgtgcaatgcgtgatgaaaatggtaaagatattcaatcggcaggtccatcaattcctgtagaagtactaggtctttcaggtgttccggcagcaggcgatgaagcaacagtcgtgcgtgatgagaaaaaagctcgtgaggttgctctttatcgtcaaggtaaattccgtgaagtgaaattagctcgtcagcaaaaagcgaaactggaaaacatgtttagcaatatggcagaaggtgatgttgcagagttgaatgttattgttaaagcggatgtacaaggttctgtggaagccattgttcaagcattacatgaattatcaacggcagaagtaaaagtaaaagttgtgggttccggagtgggaggaatcactgaaactgatgcaactcttgcagctgcttcaaatgcgattatggttggtttcaatgttcgtgctgatgcaacagctcgtcgtgtaattgaaaatgaaaatattgatttacgttattattcaataatttatgaattactaaatgaaatcaaagcggctatgagtggtatgttacagccggaatttaaacaagaaattattggcttggctgaggtgcgggatgtattccgtcatccgaaattcggtgcaattgccggttgtatggtaactgaagggctggttaaacgtaacaacccaatccgtgtattacgtgataacgtggtaatttttgaaggagaacttgaatctctccgtcgttttaaagatgatgtcagtgaagtacgtagtggtatggaatgtggcattggcgtaaaaaattacaatgatgttaaagtcggcgatcaaattgaagtctttgaagtagtggaagttaaaagagcgatttaatttgtaaccggtaatataattttgttggttgaattataactaaagagcgagattatcatatattaagttgcttaatgtttttgtggataagaatgcccttaactttgttttttaaggttaagggcattggagttttatcatgtttgagaagagcaactgtgtatagtggtaaaaattaggaaaactcaccgctctttttaaggtgtaatttctcaactctagagtgaatttaccaacattaatggagaaaaatatggcaagagaatttaaacgtagcgatagagtagcacaagaaatacaaaaagaagtagcagttattttacaacgtgaggttaaagatcctcgtattggtatggtcacggtgtcggatgtggaaatatcaagtgatttagcgtatgcaaaaatatttgtcacttttttatttgatcaagatgaaaatgttattgagcaaggtatgaagggattggaaaaagccagtccttatattcgtagtttattaggcaaagtgatgcgtttgcgtattgtgcctgagttacgctttatttatgaccaatctttagttgatggtatgcgtatgtccaatcttgtgacgaatgttgtgcgtgaagatgaaaagcgtcatgtagaagaataagcgaataaaaatatgagtaaaccacgtaaaaaagggcgtgatatcaacggtatttttttgttggataaatctcaagggatgagttccaatgacattatgcaaaaagttaaacgtcttttccaagcgaataaagcgggacataccggtgccttggatccgctggcaacaggaatgttgccaatttgtttaggtgaggcaacaaaattttcacaatatttacttgatgcggataaacgttatcaagttatcgctaaattaggcgagcgtacagatacttctgatgccgatgggcaagttgtgcaaaagcgagaggtcaatattgatttagcaaaaattttgaccgcacttgagcaatttcgtggtgaaattatgcaagtgcctactatgttttcagcattgaaatatcaaggcaaagctttgtatgaatatgctcgtgcaggcattactattgagcgtgaagctcgtccaattagtatttttgaattgaagtttattgactatcaaataccttatttaacattggaagtacattgttctaaaggaacttatattagaaccttagtagatgatttaggtgaagtattgggttgtggtgctcatgttactaggttgcgtcggattgctgttgcagattatccttataacaagatgatgacgttagaacaattgcagcaattctctgaacaggaagatttggatttattggatcaacatttgttacctatggaaagtgcggttattcgtttacctggattgcacttaacaaaagaacaggcaagagctgtaggatttggacaacggattaagtttttaaatgaacaaggcatacaaggacaagtgcggttaatttctcctgaaaatttatttttgggtgttgctgttattgatgaaaacagcattgtccatcctcagagaatggttgttattaaacccgaataaatccaaccgcacttaagggcagatttattctgcccttgttttgtcaattaagctaattccgctcgtaattttttagtgaccgacatcatcacttcaagttgtgcaatggtctctgaccagccacgtgttttcaagccacaatctggattgacccataaacgctcttttggtacaacgttaagagctttgcgaagtaaatgttcaatttcttctgctgttggtacacgaggactatgaatatcatacacacccggtccaatatcgtttggatatttgaaatcaccgaaagcggttagtaattccatatcggaacgagaggtttcaatggtgatcacgtccgcatctaaagctgcaatagccggtaaaatatcgttaaattcagagtaacacatatgagtatggatttgtgtatcgtctgctacacccattgagcttaaacgaaatgcctctcccgcccattgtaaataagtatcccaatcggctcgtttgagtggcaatccttcacggatagcgggttcatcaatttggatgactttgattcctgctttttctaaatccaatacttcgtctgaaagtgccacaccaatttgcttacataccgttgaacgtggaatatcgttacgtacgaatgaccactgtagaattgttacaggaccagtgagcatacctttcatcactttcttggttagactttgtgcatattttgaccaacgtactgtcattggttcaggacgaacaacatcaccataaattacaggcggcttcacacaacgtgatccatagctttgtacccaaccaaatttagtgaaagcaaaaccatctaataattcaccgaagtattctaccatgtcattacgttccggttcaccatggaccagcacatctaaatccaatttttcttgttcacgcacaacaagttcaatctcttttttcattgaattttcatactcttctaaagagagatcgcctttcttaaacgctgctcgagcacgacgaatttcggtagtttgtggaaacgaaccgatactggttgttggtaagagcggtagatttagccaagcattttgtaatttgatacgttcaccaaaaggtgatttacgttgatcggcattttttggcaaattagctaaacgttcagctacttccggacggtgaatttcttttgaatttgcacgagcatctgctgctacttggcttgcatctaattctacatttaccgcattacgacctttttcaagagcggtttttaagacgcttaactcttgtactttttgtaaggtgaaagctaaccagctataaagagcagggttgttctcttgtaattgggtttcaacatttaaatcaaatggtgtatggagtaaggaacagcttggagcaatccataaacgctcacccagtttttcttttagtggctctaatacatcaagtacagtatttaagttagctcgccaaatattacgtccgtcaattacgccggcagacaataccttgttgtaatcttcgaatgctactagttgctccggagcacgaactaaatctaagtgtaacccatctactggtaattcttttaataaagtagcgtgttctgttactgaaccgaaataagtagctaataataatttcgcattcactttttcagatagcgttgcgtaaacgtctttgtacgcattaacccactcttttggtaaatctaccgctagtgcaggttcatcaatttggatccactcggtaccttctgccacgagtgcgtttaaaatctctacatacacaggaacaagttgagcgagtaattcaaaacggttaaaggattcgcctttctctttccctaaccataaaaatgttaaaggcccaacaattacaggtttaacttggtgtcctgcaactttcgcttcacgaatttggtttacataatgtgttgggtttgctttgaattgtgtgtctttatgaaactccggtactaaatagtggtagttggtatcaaaccatttggtcatttcaatagcaaattggtctttgttacctcgtgctaattgaaagtactgatcaagtgtcaaatttttactatcgaaaccgaaacgagcaggaatagctcctgttgcgacttgaagatctaaaatatgatcataaaaggtaaaatcacctactgccataaaatccgcattagcatcagcttggtgtttccaatttttttcacgtaatgccttagctaaatctaatagatcttgctcagccaactctttacgccagtaacgctcttgagcgaattttagttctcttttggctccaacacgtggaaaacctaaaacgtggaatgttgtcataactaaatctcctgtatggtaagtacaattttgaatagacgtctaaacgtctgtgttttggtataatgcaataaaagtctttaatgatgcaatctcataattttcacgttttgtatgaaaaaaattaataaaagagcggtgtaatttaggtaagattaatagaaaaaagtaatgagcatgaagaggttgttattgaggcgtttttttatgggcttggtttagcctcttcaacaggtgcagatagaacatcccaaatagatggctttggctcttcgggaatgtcattacaaaaaaattgatcgttatttatccaaacaggaagctttttaggacttgagcaattccagtttccataagagtctataccaatccattcaattttagctggtgtttgtggatttaacatttttatttcagcacgagataaataatcttgatagatttttaatgcaccactcgcaccggttaattttgttgttacattatcatctcgccctaaccatacagtaacaacattctcaccatcaataccaacataccaagtatctcttgattcatttgttgtacctgtttttccggcaagtttaagtgaagcgtattgattttgtaagctacgagctgtccctcgttcaacgacttgttgcatagcaaataaggtttggaaagctgcttcttggggaacgacttgttgtggcattattgaacgttggtaaatcagattcccctgcttgtctgtaatactgtcaagagttgacaacggaatatgttttccttcattggcaatagtttggaataattctgtaacctcataaggggaaatagagtaactacctaacaaagttgaaggcacgttaggtatttttacattatcccaacccattgccatttgcatttcaattactttgtttaagcctactttcataccaatattaactgttggaatattgagcgagcgaacaagtgcatctattagcatgacggaaccactgtattttctatcgtagttacgaggctgccatggctgagttcctttgatacgaattgtaataggctgattttgaataagcgtattaaggcgaaattgctcaggatcagataacgccgctaagtaaattgacggtttaactaaggaaccaatttggcgacgagcgtgtaaagcacggttaaatcccgcatagtttgtctgtaaaccaccaacaatggcttttacttcacccattttataatcagcaataatcatcgcactttctaaatgtggatttttatattttcgctgtaattctgagactgcttttatcacggatttttctgcatgttcttgttgtttcggatccaaagtagagaaaattcttgcaccggataaagaggaaagtttgttttcgcccagtttgcttcttaattcttgctgtagagtttgaataaatgccggatacttgcggttaatttgtcctcttttttgtacgccgagaggacgtttactgagtaagtcatagagttcattactaatcattttatgattgagcattaattttaatacaacattacgacgttctaaggccttttgagggttacgccaaggattgtatagtgaaggaccttttaccatgccaaccaacaaggcaatctgatccaaactgatttcccgaacaggtagcccaaaataaaaatggcttgccaattcaaatccatgaatttgtgtgctgccattttgtcccaaataaatttcattaagataggtttctaatatgcgatttttatcgtaacgaaaatctaaaatcaaagccattaatgcttcattcattttacggcttaatgtgcgttcgttgcttaaaaataaatttttaaccagttgttgtgtcagtgtacttccgccttgtacattatgtcctgctttgatgttggtaattaaagcacgaataatgccaagcaaacttattccatcatgttcataaaaattgcgatcttcggttaaaagtaaagtatcgatcaataatcttggataatgttgtagcggaatagctagacgttcttctctatctgattgcaacatcgcaataagttttggatcaagacgaaactcactgatggtttttacattgatcaggtcttcaatgatagaaagtttattatcattattaaaacgtaggcgaaaaaggcgttgtgcttcaggttgacttgggaaagggaaggctctgcgtaaaataaccaaagtattattttcaattttaaaatcaccgggcgtggcaagcatggtcgtttggcgatattcattttctaacagtgcttgtttgatttgttccagattcagttgatcagataaacgtatgttttcaatacggctataaacctcggcgggtaactgccaaatttgaccatccattttattgcggatttttccgtctaaataaataccgtaaaatgcaattccacataatagagtaaaaccaagttttgcactaaaaataaacaaccgttgttttttatttttcttttttggttgagttgtatttcgtttttgtttcgcagccatttttatttagtttaagcaataaaagagagataggattttagaaaatattcaaaatcttctaagccacaaaaagcaatactttcttcatcataataatggaaatcagcttccagttcatcgtgttcttcaattgctaaattattggctttaatcataacttcatctgaatgaataaaaacagaaaattcgtttccaatgagactaaactccttttcattgcgtgattgttttgcttgttgcagataattaagtgcggtaggaatcaagtcagaatttaaccgcacctctatattgaaccaattagctattgcctcatgttccatagaaaaattaactgttacttgatcagcgttgtgagtaaattgatagtccattatttagatgctaaaagatgagccgcaaccgcaagttgttgatgcatttggattgtttacaataaatcttgagccttctaaaccttcagtatagtccacagtaccaccgaccaggtattgtaaactcattggatctacaaccaatttaacgcctgaattttcaacgattaaatcgccgtcattggttttttcatcgaaagtaaagccatattggaaaccactacaccccccaccggtaatataaacacgtaattttaattctgtattttcttcttctgaaattaaggttttgactttatttgccgctgcatcagtaaatgtcaaaggaactgcaatatctgccatagtattttccgataataaaaattagtgggctattatctaataaccaaccaaaccattcaagatttataaaaaatttaatgttataatgcacgacaaattttatgtctagagaagatattatggcgattccattaagaacagaacaagaaataataaagttacgtacagcttgtaaattggcatctgacgtgttggttatgattgaaccttatgttaaggcaggtataacaaccggtgagttagatcgtatttgtcacgaatatattgtgaatgagcaaaaggcaattcctgcttgtttaggctattatggctttccgaaagcaacttgtatttcattaaatgaggttgtttgtcatggcattccgactgaaggcaaagtgttaaaaaatggtgatattgtaaacattgatgttacggtgattaaagacggctactacggcgataactcaaaaatgtatattgtcggtgaaaccaatatccgcagtaaaaaattagttgaggcggcacaagaggcattatatgttggtttacgagtggtgaagccggggattcgtttaaatgaaattggtagagcagtgcaaaaatataccgagagtcaaggcttcagtgtagtgcgtgagtattgtggacatggcattggtaccgaatttcattgtgatcctcaagtgttacattattatgctgatgatggtggtgttattttacgggagggtatggtttttactattgaacctatgattaatgcgggcaaaaaagaagtgcgtttaatgggcgacggttggacagtaaaaaccaaagatcgtagccattctgctcaatatgagcatcaacttgttgtaacgaaagatggttgtgaagtgatgacgattcgtgaggaagaagaaaaagtcggacgaattagtagaataatggttaatatatagtatcaattcaacgtgcaatcttttcaaggttgcatttcttttatttcaggacatgctatgttttcttatcttccaattccaaatccaacgatagcaacaataaaagcacaaaaagaacagcttaaacagtttgagttgacatattttcagcggttttctgttgatcaactcattcgtaatcgttcagtattttgtgatcagttattaattcacctatggcaaatttttcagcttgagaaaaatcacttaacccttgttgcagtaggcggttatggacgggaagaactttttcctttatcggatcttgatgttttgttgttagttgaagatgaacctactatcgagctggaggaaaaaattgcacatttttttcggtttctatgggattgtggatttgaggttgggcattcagtacgcactttagcccaatgtgaacaaagtggacgagaagacatcaccattgcgaccaacttattagaaagccgatatttatgtgggcaacaagatttattcgaaaaattaaccgcacttttgcaacaaaaaaatttttggcgaaatgaggatttttttaatgctaaagttgcagaaaaagttacacgctatcagcgttaccataataccggttataaccttgaacctgatttaaagtatagcccaggaggattgcgtgatttacatcttatttattggttggctttaaagcatataggtgctaaaaatttagaagatattttgcacgctggttttatttatccacaagaatattctttattaaagcaaagtcagcaatttttatttcaagtgcggtttgctttacatttaattttaaaacgttatgacaatcgcctgttatttgatcgtcagcttaaagtttgtgaattattaggttttgttggtgagggcaatcaaaaggttgagaaaatgatgaaagtcttttttcaagcttcacaatctatttctgtattaagtgatattttggttaaacattaccaagagcattttttagccggttcacaaattattgagcaacaagatttagattccgatttttatcttatcaataatgcaatttgtgtaaaaaatcctgatatatttattcaaatgccggataaaatattgatgctattttactatttgacacaacactctcatgttgaaattcattctgcaacattacgcaagttgtatattgttactcaacaatttactgggaatttatctgattttcctcttgcaagagaacgttttttacgtttattttcacaacctaattctatttctcgtgctttgttaccgatgcacaaatacggtgtattgaacatttatttaccacaatggaaagggattaacggattgatgcagtttgatttatttcattcttatactgttgatgaacatactttgcgagtgatgttaaaattagaagagtttttagtggaagaggcgaaaaaaaattatccgatctgccacaccattttctcatcattaactgaccgcactttattatatcttgccgctttatttcatgatattgcaaaaggcagaggaggggatcatgctgaattaggtgcagttgatatgcgtatttttgcacaacaacatggctttgatagtcgagaaagtgaaactatggcatggcttgtacagcgacatttgcttatgtctgttactgcacagcgtcgagatattcatgatcctgaggttattctcaattttgctgaagaagtacaaaataaagtgcggttagattatttaacttgtttgactgtggctgatatttgtgcaacgaatgaaactttatggaatagttggaaaagatccttatttacgactttataccaatacagcctagatcagtttcaacaaggaatagatattttattaaatcatcaagaaaaagctgaagaaaaccgcaaacaagcgtgtattttattacaacaaaagtatggatttttatctgaagctcaaattgagcatcactggcaagattttccttgtgagtatttttggcgtaatagcccgaagcaaattgcttggcattctgagttgttacttgataataatcaagatttattgattaaagtcagtaatcgtttttcttatgcagggacagaaatttttatttattgccaagatcaagcgaatttattttataaagttgccagcattattggagcaaagaaattgagtattcatggagcacaaattatcacaggaaaaaatggctatgtattcgatagtttgattgttaccgagttggatgggggcttgctgaacaatgatcgtcgccgtcaattggaaggtgcattaattaaaggattaaaaacaaacaagattgttaacccagttcgtataaataaccataaattacaacatttccatgttaaaacagaagtcagatttttaaatgttcataagcaagaacaaactgaaatggagctttgtgctttagatagagcaggtttattagcagaaattagtcaaatatttgtacaattggagttgaacttattaaatgcaaaaatttctacaattggtgaaaaagtagaggattttttcattttaaccaataagaaaaatgtagctttaacagaacaagaaaggttacgtttacaagatcgtattgaaagtaattttagctaaagataaatgtctacattgcatagattttttatgctaaaatccgcaaccgatttattttattgctgaataggaaaaagaatgaaggttttagaaggtatagttacagcacctaatgccaaaattgctgttgttattgcacggtttaatagttttattaatgaaagtttattagagggagcattggacgctctaaaacgtattggtcaagttaaagatgaaaatattactttagttcgtgtaccaggagcttatgaattgcctttaattgctcgtcgtttagccgatagtaaaaaatatgatgccattgtagcgttgggtactgttattcgtggcggtacagcacattttgaatatgtagcaggggaagcaagtagtggtttagggcaggttgcaatgcaggcggaaattccggttgcctttggtgtattaactacagaaaatattgaacaagcaattgagcgtgcgggaactaaagctggtaataagggggcggaagctgcacttgttgcattagaaatggtgaatttgttagctcaaattgacaaggcatagtagataaaatgacagaaaaagtaaaaaaaatatccccacgtcgtcgagcaagagaatgtgcggtacaaaacctttattcttgggctatttcaaaaaattcacctgaagaaatagaattaaacttcattgtggatcaagataatgagatgaaaggcgtggatatgccgtatttcagaaagttgtttcatcaaacaattaaccatgttgaaactattgatagtacaatggcaccttacttagatcgtgataatgttgagttagatcctattgaatgtgcaattctacgtttagctgtttatgaattgaaatttgaattggatgtaccttataaagtggtgatcaatgaagctattgaggttgctaaagtatttggtgcagaagaaagccataaatatattaatggtgttttagataaaattgcacctgcactttctcgtaaatagataggtttatcataatgagcaatggcgaatttgatattattcaacgctatttcatcggatcaaaacgtccgcaacgtaaagatgtgattgtttctatcggtgatgattgtgctattactgaacattatcaaaatcagcgaattgctattacgactgatacgatggtagaaaatgtccattttctgtcttctattaatccttcggatttagcatataaagctgttgcaacaaatttaagcgatcttgctgcaatgggggcgactcccgcatggttttctcttgcaatcactttaccttatgttgatgaaaaatggctcaatgaatttagtcaaagtttatttgatgtattggatcattataatgtgtcgcttattggtggagatacaacaaaaggtcccgtatatacaataactattactgcacaaggcatcgtacctaaagggaaagcactttgtcgccatagtgcacaagatggtgactggatctatgtttccggcacattaggagacagtgcggcaggattggaattactattaaaaaatacagaggaaacgcatagtaaaagtcatcaaagtgcggttgattctgcacaagaatatttaattcaacgccatttgcgtccaacccccagagttttgcttggtctggaactagctagtgctgagttagcaaatgctgcgattgatatttctgatggatttattgcagatttaggacatattttacagcgtagtcaatgcggtgcagtgatcgatttagataaattacctttatctgagcagttaatcaaaactgttggtatagagcgagcggagcgatttgctttaactggcggagaagattatgagttgtgctttacagttcctgatcgtaatcttgaaaagttagagcgagctttaacccatattggtgtgaattatagctgtgttgggcaaattcgtaataaaaaacgtatcagttttcaacgcagcggtaaaaccgttgagattggttcattactcggctttgatcattttaaataagatttcattatgacaaataatcctttatctcgtatttctttaaccaatcctattcatttttttgcacttggcttaggttcagggcttattcatcctgctcccggaacttggggtacccttgccggattaattgttggttgtttgctattacagataatgtcggtgttttcttttgcaattttcactgcactttgttttttattaggatgctatttgtgtcaacaaacagcggatgatatgggcgtacatgatcatggctcaattgtgtgggatgagttcgtcggtatttttaccgtattactcgctattcctgaattatcattgatatggtgtagcattgctttcgttgtattccgtatttttgatattttaaagccttatcctattcattattttgatcatagattagaaagtggcttcggtattatgttagatgatgttttagctgctatttatacggtcataagtatttctatcttaaattatctcgtgtagaggcgattgattatgctgaatttattattggttaatttattcgggttacttaccccgggacctgattttttttacataagtcgtttagcagctagtcattctaagagaaatgctatttgtgctgcgtttggtattagcttgggttgtttagtttggtcaacttcagcaattcttggactggctgttttattgacaacttacccaagtttgcaaggcattattatgatgctaggtggcggatatttggcttaccttggtgtattaatggtgaaaagtcataacaatattgtctttgataatcgtgaacaagcagaaaatttaagaaacagtatgggtaaagaaatcttaaaaggattactgattaatttatctaatgcaaaggctattatcttctttagtagcgtgatgtcttttgtattggttgatttaactgaaacatggcagattattaccgcacttattttattaactcttgaagtatttttgtatttttcttttattgcacttattttttctcgtaaaaccgtaaaaaaattttatagccaatatagccattatattgataactttgcagggatcttttttctttgttttggcggttatttaatttatagtgctcttttcataggatttggcaattgataaatagggagggataaaatgacgttaaaaattggtattgttggttcgggtggtcgtatggggcgtcaacttatacaggcagtatatcatactgaaggtgtagaacttggtgcggcatttgagcgtgttggttcatctttagttggaactgatgcgggagaactggctggaataggtaggattggtattaaagtaaccgataatttaactcaagaaaaaggtaactttgacatattaattgattttactcgaccggaaggtaccattcagcatttagcattttgtgtagagcaacataaaaatatagttatcggtacaacaggatttgatgatcaatccaaacaagctattcaacaagcagcacagaatattgcaattgtttttgcctctaattatagtgtgggcgttaatttagtttttaaactgttagagaaagcggctaaggtcatgggcgattattgcgatattgagattattgaagctcatcatcgtcataaagtagatgcaccttccggtactgcactatctatgggggaacatattgccaaaacgttaggcagagatttaaaaacgcatggcgtgttttctcgggaaggtattacaggtgaacgtaagccggatgaaattggattctcaacaattcgtgcggcggatgttgttggtgagcatacagtatggtttgcggatatcggtgaacgagtagaaatatctcataaagcctccagtcgaatgacttttgctaatggtgctgtaagagctgcaaaatggctttctactaagcaagaggggctttttgatatgacagatgtactggatttaaataatctgtaagtgcggttagatttggttcttgaaaattgtgcatctttgatctttcagtattcgtcatttaagatgttgctaagatgttgatggaataaaatcaatgccaaaattttagtcagtccgaaaaatgggtataatgcccactgatattatatattttaggaatagtagtatgaaatttatttcatttaatattaatgggttaagagcaagacctcatcaacttgacaggattgtagagaaatatcagcctgatgttattgggttacaggaaattaaagtgtctgatgaagactttccctataatcttgttgaacatttaggctaccatatttatcatcatgggcaaaaagggcattatggtgttgctttgttattgaaacaagaacctaaagtaattcgtagaggcttttctactgacgatgaaaatgcacaaaagcgtataattatggcggatttagaaacagattttgggttgctaacagtaattaatggttattttccgcaaggtgaaaaccgccagcatgaaacaaagtttccagccaaagaaaaattttatgcggatctgcaacattatgtagagcaagagcatgacagaaataatccaattttaattatgggggatatgaatatcagcccgacagatttagatattggtattggtgaagaaaatcgaaaacgttggttgcgtacaggaaaatgctcatttttaccggaagaaagagaatggataaatcgtctatataattatgggctgattgatacctttcgtcataaaaatccgacaatcaatgatcaattttcatggtttgattaccgctcaaaaggctttgatgataatagagggttacgaattgatcatattttagtgaatcaattattattagaacgttgcgttgacgccggtatagcttttgatattagagcgatggaaaaaccatctgatcatgctccgatttgggcggaatttaagtgaggaacatagaatgggaattgaacaagaatggcaaaattatcgatctaaaattaatgataaattagccgtattttcagttaatttaaaacttcttgaacaatttccagtcgtaaatcatatatgtgaaattgttgtccattttgaagtcccttatatttcagatgcacaaggcttaccgcaaatagaaagttacgccggtttgcaacaagatttgctcaaaatatccagtttaatttctgcccaacctaatgtttattacgcaggcaatattctttgtaatggcaatgctacattgtatttctattgtaacgatgctttagatattacagatgtattatctgataattttccaaacgctgtaaatattgagaaacaattcgattcaacgtgggatctatattttgattttttgatggcatctcaggcagatttgaaagtaaatgcagcagaagaattattggcaactttaattgaaaaaggagaagatatctcgaaaagttatcaaattgagcatactttttacttttacaaagaaaatgatctttacttatttttggagaatattgctacttctgatatatcatttttatcgctaaaacattcttctaagcaaataagtgtgaatggatataatgtatatattgctaaaatagagcaagaattgtatttaaatgatgccagtatctatgaatatataagaaattttgaagaactcgctttgcaacattcaggtgaatatattggttgggagagcgaagatattggtataaataaaaatcaactaaattaatttttaaatttaaaaaaccttacaacagaataagatgtaaggtttttaatcggattaaagcaccttgacaatactttcacataaataacgaatattatcttcagttacaccggctaaattaatacgtcctgaacgcacagcataaatggcaaattcttcttttaagcgatccacctgttctgcatttagaccactaaaagagaacatgccattttgttcaataatgaagctaaagtcttgctttgcaccatattcttttaacaattcaacaaattgataacgcatacgtttaatgcgattacgcatttcggttaattcggattcccattgttgacgtaataggtcatcacctaaaatgatagaaacagctgtagcaccatgagaagctgggttagagtagagagtacgaataattgatttcacttgtgttaatgctattgctgaaatttcttctgtttctgctactaaagtaaaggcaccaacacgttcattgtataaaccaaagtttttggaataagaacttgcgactaataattctttatgattttctgcaaaagttcgcaaaccaatagcatcttcttctaacccgttagcaagaccttgataagcaaaatcaaagagcggtaaccaaccatttttttctgacatttctgctagtattttccattgctcaggggttggatcaatacccgttgggttatgacaacaaccatgtaataacaccacatcaccttcactggcattgcttaagtcagcaattaaattatcccaatctaaagcttttttctctgcatcgtagtaacgatattcacggattgtcatacctacagcgttgaaaatagcattatggtttggccaagttggtgaactaatccaaacgttttgagatgtggtttgacgtttgataaattcggcagcaatgcgtaacgcaccggttcctcctaaactttgtactgttttagcacgtccttgtttaataattttagaatttgtaccaaataataattctttagtgtatgaattaaactctgcaataccatcaatagttaaatagtttttagtggtttctaattcaaatagacgattttcagcttctttaacagctttcataatgggggtgttaccattagcatctttatagaccccaatacccaagttaattttattggcacgcatttcagatttaaaagcctcacctaaacctaaaattggatcagcgggtgccgcattaatattctcgaacatagtagtatcctcaataaatagttgtgtttgaatagatttctttatactggtaaaaacttatctttgcaagcctttagctaagttaaatttaattatttaattttaactttataaaatatattaaaaattatttgctagattaaattatttcaatttttctaatgcccaatctaaaccaaattgataatcttgcggtagtatgtagcgtaatttttgtaaattatctattaaaatagacggagttggatgagataaattaagatgcccaactttacgaccttctcgtacttcttttccataccaatgtaattgtgaaaatggcaaatttaaccattgtagattatgttcagtgccaattaaattcaccataaccgacggcatagccacttgtaaatcaggcgtaggtaaatctaataacgcacgaagatgtaattcaaattggctaatcgaacaacctaattgcgtccaatgtccgctattatgtactcttggtgccaattcattgactaataattgatcttgcacaacaaaacattccattgccattacgccaacataatctaatttatccataattttagccaacattatttcggcttgtttttgttgttgtgattgttgtggaaaatttaaattcatgacgctgtaacgtaaaataccattctgttgcagattatgcgtaacaggataaaaacgagttttgccatttttaaaccttgcaccaaccaaagaaatttcataatcaaaaggaataaatttttcggcaataacttcgccaaaaagctcattgccgattacatcttgattatttttatctacaatccattgtcctcgtccgtcgtaacctcccatgcgacgttttacaacaactttttcaccaatttctgtaaaaatagtgaaaaaatcctccgcactttgtaccaacctccaaggggaagtaggaatatttagtgcgttaagcaaggttttttgtgtaaaacgatctgctgtagtggcaaaaattttttgattaataaatttatcgtgattagccaacatttctgtaaggggtgttttttcccaacgctcaatttctgctgtaataatactgtcagcaggcaaatcaaaaacaggtgcatcaaaagcaagaggttggacattaatatctaaaggtgcacccgcataacgcaacattctgcccaattgcccattacctaaaacatacactgtaggatataaagtgcggtttaccattaaatgatccttatacttaattaagatattgtaaatttttatttactctgattttacttgatgaggttttagtagtaactcatcttcgttcaatttaaataattttgctattgtatcacgataggatatttctaaagtttctcggctggttgccgttacaccttgatcaattaaaaaaccgtcgttaacatcataaatccagccatgcaaagaaagtttttttccacttttccaagctgatttaacaatagatgagctgcctaagttatacacttgttccgcaacattaattcttgtcaacatatcagcgcgtttttcgggagataacttacccaataaatgaccatgtttaaaccaaatatcacgaatatgtaacaaccagttattaatcaatcccagatcttgatccaccatagctgctttaataccaccgcagttggtatgcccgcaaataataatgtgctcaatattcagtacatcgacagcatattgcaccacagataaacaatttaaatcagtatgaataacttgatttgctacattcctatgcacaaataattcaccgggttttaaatttgtcaaattttcagcaggaacacgactatcggaacaaccaatccataaatagctaggtgtttgattttctgctaacgctttaaaatactcagcattttcttctttcatcctatttgcccaactaaaattattggcaaataactgttcaatttttttcatttttttaccgctcctaaagatgcacagtatagcctagaatagaaaaacggtaaaataaaaagccctgtaagataacagggcggtgaaatttaggtaggattgaatatcatcacaacaatgtcgcttgtttcattttctgcacgaattctgccaattcggagaggcatttttctcgatctgtgagattttgttcaatgatttgcactatagctgaacccgaaattgcaccggcaacacctgattttaacacgtctttaacttgttgtggttgagctataccaaaaccttgtaaaatcggagctgagccatatttttttaagcctttgatgagattagccagatttttcgcactttgttgattttcagcacttgttacgccggctcgagaaactaaataaatgtagcctttgcttttttccgctactgctttaagggttgtttcatctgcattgggtggacagataaaaaccggttgaatgtcatatttttgagcggattgaatatacggttcagaagcaagcagaggaatatcagccaccaataccgcatcaactccgacttcagcacagcgttgataaaatccatctaaagtttgagcataaattaagttggcacaaaggagtagactgatcggaatatcgggatatttggaccgcactttggcaattagttgaaaactttcttttgtactgcagcctgcgtttaaagcacgatgattagcagcttgaataaccgaaccgtcaagtaaaggatcggagaaaggaaacccaagttctaaagcatctgcaccgttatccactaaggtacaaataatttcaaaagagcggtcgaaatttggatcgcataaagtaacaaaaggaacaaaagcaccttgtttttgcttttgtagttgtaaaaatttttgttcaaaatatcccatcagataattcctttctcggttaaaattttatctacagtaaaaatatctttatcgcctcgacctgataaatttactacaagtaattgttctttttccggattttgtacaatgagttttaaagcataagccaaagcatgtgagctttctaaagcaggaataataccttcatgtttggctagggcttgaaatgcctcaattgcttcatcgtcagtaatactttcatattgagctcgcccaatagtatgtaaataggcgtgttcaggaccaacggatggaaagtctaagccggcggaaatagaataagattcctcaatttgtccgtcttgagtttgcataatcggggatttcataccaaagtaaatgccaatggagccatgacgaagtggtgctccatgctttcctgtatgaataccgttgccggcaggttcaattccaataagttgtactgatttttctgcaataaactcagcaaacataccaattgcgtttgaacctccacctactgcggcaataacagcatcaggtaagcgattttccttagctaaaatttgacatttagtctcttcaccaatcattttttgaaattctcgcacaatagtcgggaatgggtgcggtcctgctgctgtacctaataaataatgggttgtctcataattagctgaccaatcacgcatagcctcacaacaagcatcttttaatgagcaagaacctttttcaacaggaataacttcggcgcccattaaacgcatacgaaatacgttcggcgattgacgctcaacatcttttgctcccatgtaaactcggcaaggcatatccaacatggcacaagctaaagctgtggctacaccgtgttgccccgcaccggtttccgcaataatacgtgtttttcccatacgttttgctagcaaaatttgccctaatacttgattggttttatgtgccccgccgtgaagtaaatcttcacgttttaaatacaattttgtttttgtacctttagtgaggttgcgacataaagttaacgctgttggacgacccgcataatttttaagcaaatcttgaaattcttgctgaaacacaggatcgtgctgtgcttcaacaaaagccttttctaattgttttagtaccggtaccagaatttccggtacatacattccaccaaattcgccaaaatagggatttaaaattgtacccatcatattttttccttattgatttttgattttgtcaaaaactgtttgtaattttatttgatcttttatgccgttggcacattcaacacctgaatttaaatcaatccctagacaatgttgttgcaatgcttgttcaatattttgaatatttattccaccggcaagcatgactttgtatttaatggagggaggaatataattccagttaaaagtttgtcctgtgccaccttgtcgattatctgccttactatcaaaaacataacgatctacataaggaatttcttcaaaatctaccgcacttttcccttgttcatattgctcggtaacgtcaatcgtaacagctttccaaatttgacattgtgtaggtagaacttggcgaagtgcggtaataaattcagcattttcatcaccatgtaactgcacggcgaacaattgtaattgtgtagcgatgttatggataaacgcaatagactgattttggaaaacgccaacaaaaagcaaaggtgcttgcttaaccaatttctgtgcttgacatagggagagtttacgaggagaaccttcagcaaaaatcaatccgccgtataaagcaccttgagcatagcttgctttgacatcttgtcctcgtgttaaaccacaaactttgtgctcccccaaaagtaccgaacgtacggcattgttaagatctttaccactagttaaactgctaccgattaaaaagccatgtacatagggttttaattgttgtacttgttgatgagaagaaatacctgactcgctgatcacaatgcgatctgccggaatttgtcttgccaaaggaggcgtgcggttaagatctacggagagatcgtgtaaatttcgattattaattccaattacttttgcacccagttttatggctcgatctaattccttttggttggatgtctcagttaaaacgcccattccaaggttatgtgcaagatcagataaagtgcggtaagtttcatcatcaagtatcgacaacatcaataaaattccatcagcttgataataacgtgctaaatacacttgatatttactcagtataaaatccttacaaagaacaggttgagtagccttcttacgtactaagggcaagtagttaaaatctccttggaaatatttttcatctgttaaaacagaaatgaccgaagcataatttttatagacatttgcaatttctactatattaaaatcagaacgaattaaacctttcgaaggtgatgcttttttgcactctaaaatgaaagcggggcgttgatgtgagccttggcttaacacttgataaaaagagcggtcggaatttttaatttcttgctgaaaatgagcaagaggaaatgcagcttgtttttctgcgatccatcgttttttatcttgtacaattttttgcaaaatagaggggatattgggttgcatgataattcctatttattgatacagttttaattggtttaatgtttcaaatgctttaccgtttgccataatatttaaggctttttctgcattggctttaatatcatcattgccaaataacttcattaataaagcagtattcatagcaacagcttgattatgctcatctttacctttcccttgtaaaagtgcggtcaatattttggcattttcttctgctgtaccgccacgtaacgtttctaatggtttaggagtaaaaccaaagtcatgaggtgttaaactataatattcaatttttccatgacaaatttccgcaacatcggtttttccatgaatagcaacttcatctaaaccggaaccatgaataacgatactatgctgatgccctagtcttaatgcactttcagcatagattttaagtaagtgcggtgtataaacccccagtagttgatgttttgggcgagcgggattgcataaaggacctaaaatattgaaaatcgtgcgtgtttttaatatttgtcgtacaggtgcgacatgtttaaatcctagatgatattgttgtgcccagagaaaacaaaggttgagattatctagggcttgtttggacttttcagcagataagtcaatttttatccctaaagcatttaatacatcacttgcaccgcttttgctggatacacttcgattaccatgttttaccactttgtatcctaatgttgcagcaacaattgccgcagtagttgaaatattgatggtattagcattatcacctcccgttccgacaatatcggcaaaagggtagtctatgaatggaaatggcttagcgttggcaataatggcttttactgcaccgctaatttcatctgtttgttcaccacgaaattttaaggcgataagtacgcctgcaagttgttcattagaaagttgtccttgaataatataatgaaataactgttgtatttgttcttggtttaaatgttgtccgtcgaaaagttgactgattaattgttctgtttgcatgttgttttccttcttatttttcgttctattttgacgtcggtaaatcataaataattatattgttctctactttgagccaataaccattgaatactttgctctaataactgtgagccttgcttcgttaatatactttcagggtgaaattgaaaactacaaataggcaaggttttatggcggatagccataatgatgcccttatattcagcattaataataaactcttccgaaatttttcttcccattaaagaatgataacgagcaactggcataggattatctaacccctgaaacatcatttggttatcatgataaatatttgatactttcccatgtgaaatttcaccggagggaacaacgtctccaccgaatgcttcaatcaaagcctgatgccccaaacaaatgccaatcatagctactttaccttttagtgtttgaattaaaggcaataaaattcccgcctgtgcaggagtacctggacctggtgagagggctaaaacagtctctttttctgctaaaataatttgagttaataactttaaatcgaagttattgcaaaaaacttgtacttgatgccctaaactgcggaattgatctactagattgtaagtaaaggaatcaaagttatctaaaaatataattcttgccatattgtctccttagtcttgagtattggtttgcaatattgcattaatcacagctttagctttgtgacgggtttcatcagcctccatttgcggatcggaatctaagacttcaccacaacctgcttgaatataagcaataccttgttgtacaaaagcggaacgtatcacaatacaggtatcaaaattaccatcagaagataaatatcctattgcaccgccataactatgacgcttttgtttttcaacttggtaaattaattgcattgctttaattttcggggcaccagttaaagtccccatattcatacaagcctgataagcatgaaaggcatcaagctcggggcgtaattttccgactacacgagaaacaaggtgcataatatgagaatagcgatctacttgcattagctccttaacctgtcttgtaccgctttcacagactcgagcaatatcgttacgagcaagatcaacgagcataagatgttctgcgagctctttcttgtctaaacgcaattccaactccaaacgagtatctaattcaggatcgatattaccctgttgatcaaagccacgagaacgagatccagcaatcggataaatttctacttggcgattttcagcattatatttcaatgcactttcaggagaggaaccaaataagatgaaatcggtatcttgcataaaaaacatataaggacttgggttatttttctttaattgacggtagctggccaacgtatttgggcattccagcataaagcgacgagaaggaacaatttggaaaatatttcctgtataaatatgctgttttaattgttcaataatggctttaaaagattcgtcttctaaatttacttgtactaaaacactcgcttttgagacagctaagtgcggttcaattttcgttaatttttgacaaatttccatcgcacttttttgcacattacctaattcttgcgaatgaaaacagaatgattgtagagtagtttgttgtaattgatgatcaatcaccaataaattttctgccaaataaaatacatagtcaggacaggttaatccatcatcttctaggctaatattttccattggtataaaattaattactaaatcataggcaaataatccccctagaaaaatgggtatttttgattgagcataaatatctgttaaacaacgtaagccatcaaaaacggttgttgcctgtaatttgctatcttcatcgagattgggattaatcggagggataataacttctaaatcgctttcagacttcacaagtatttttgcttttggctgtaatttttctttaataagaggtaaaactgtttttccattgctggttaaagcgttaaatataatagtattaccgaaacaagatattttgattgcggaatttacgaacaataggctttttaaactatttttactggagatttccgcactttctaacaacaatgtattagttctttgttgacaaagtgttgcaaaaactgcggtaggatctttgtaataaggtaacttctgagttaatacttcaataaagggggcaaacataaaagaatccttctttagaataaatttaaagatgaactattaaactagtgcgaatttgttttgtcaatagtgaagtagcattattttaaaagtaagtatttgaaataaaaaaattgcaattttcttgcgagaaagcataagcaataaaattgcacttttaaataaattcgttatgataatcgactcataatttgacttatataaggaagaaaaaatgtggtctgagttattgattggttatggcttgtttattttagaaatactcacaattttattaattgttgcagggatagtgatgatgattatgacactgaaagaacgtaaatcacatcaagtcggagagttggttattacagatttatcacgagaatatgaaaataacagtaaaaaattgcgtgatttttacctgagtgacgatgcgttaaaacaacgtgaaaaagagcagaaaaaagccgataaacttaaagcaaaagaagaaaaagcccaacgtaaaaaaggggaaacgttagcagaaaaaagaaaaccacacctttttgtattgcattttaaaggtgatatttctgcttcagaaaccaccgcacttcgagaagaaattagtgcgattattgcggttgcaaaagaagatgacgaggttttattacgcttagaaagtcccggtggagttgtgcatggctatggattggctgcctctcaattagctcgtttaaaacaacgcaatattaagctaactgtagcagtggacaaagttgctgcaagcggggggtatatgatggcttgtgttgcagataaaattatttccgctccttttgccatcattggatctattggtgttgttgctcaaattcccaatattcatcgtttattaaaaaaacatgatatagacgttgatgtaatgactgctggtgaatataaacgcacaatgaccattttgggtgaaaatacagaaaaaggaaaagcaaaatttcaacaagatctagaagacactcatttattgtttaaacaattcgttacacaaaacagaccgcacttggatattgataaaattgcaacaggtgaacattggttcggcaaacaagcattagcgttacatttagttgatgaaattgcgacaagtgatgatttattgttacaagcaatcaaagataaaacagtgctttcggtaaaatatatgatgaaaaaatcactcattcaaaaattaggcaaacaagcagaagaaagtgctaataatgtgttgttacgattgctgaaacgtgatgagagtactttgatataagcttactcaacattgcccaaaaagagattaaaatttggtttacatttttgttatttgatattaatatctcaagcagtgctgacgtgatttaatgcgacaatatttttgtaaagatagaaaattaaatcgtaagctattcaaaaaatttgaagaaatttatatacataaaattaaggtaaaataatgaaactatcacgttttgtattatctgctgttgtagcagcaacattgtcggcttgtggtaatttaagtaatgtcaccgaagagggtacatcagataacttaaagtggcctaaaattgatcagtcaagatttaatcatgatggtagccaatttggatcgtggccaaactgggataacctacgtatggttgaacgtggaatgaataaagatcaactgtataacctattgggacgtccgcatttttcggaaggtttatatggtgttcgtgagtgggactatgcttttaattatcgtgagaatggcgagcataaaatttgccaatacaaaattctattcgataaaaatatgaatgcccaaaatttctattggtttccaaatggttgtaacggttatgcatcttttagtttaaatacggatctcttatttgattttgatcaagatacgttgacctcaaaaggtgaagaagctgttgataatgttgcaatgcaattagaagcgttttcagccaaagaaattaaaattgttggttttactgatcgattgggtacagattcttataacttggatctttctcaacgccgagctgatcgtgttaaagagcgtttaattgaaaaagggttaaatattgatattatcgctattggatatggtaaaacgcaacagattaaggcttgcaatgatgtacctgccaaagaactaaaagattgcttacgtccaaaccgtcgtgttgaaatttcagcatacggaaacatttcaaaaaaatatggtaatggtgagctgaaggggggaacaaccggtccatcattatattacgaaaaataatctctcttgatataggtaagggcatcaaacgatgccctttatttatagaattatttatcacttttgtgcaaaatttgattaatcaatttctgagtgagagaaacataactttgctttttattataatagcgatagctgaaattgagcagataatagagctgataaataagttttctttctaagtaaccttcttccagtggatatatttcattatagcgttgataaaaattagttgggaaaggctcaaaaagtgatgaaaaagcaatatcgcattctctatctccccaatagcaagcaggattgcagacaaaaattttatcatctacttgaatacagttttcaatccataaattgccatgcagtatagagggtttggggttatgtttgctcaaagtatctgcaacaatttgcacaatgagatctatatttccaaatatcaaacctttttctttacatacttgcaattgccaaccaatacgattttcgctgaaaaatttggcccaacttgtctgccaatcatttggttgataaataggacctaaccaagtatcaaaatctaatccatatttatctggtccttgtatttgatgtagctgtgctattttttcagcgaatattgtaaaagaagactgtttattctttgacttatttaacgcttctaacagtaaaaaactatgcccttgtgaattgccaattccataaactaaagggacattaattgaattagttttagctaaaagagctaactggtctgcttctgcacgaaacatagagcggtaggatctttcgtttatcttaacaaaaacagtttgaacctcatcattaatcagccaaatttcattcatttcacctgaatataatttttctttatgtttaataaaatagtaggcaccaaattgttctgccagtacctgagaaatagatttccacatagctcctccgatatgattcaagttagcctgactagatgataatctgaataccggtaatattctgtgataaatatcaagttttaataaatatcttattaagtagtgaatttatgtaactcttatctatttatatctttactcatatgttatgtggattgaatatttcagcgaaatgataaggatataccaattactctagttgttactaatacagtaaaatagatacgttttctaagagttttctgttaaaatgcaccgcacttttattgtacaaggtaggtataaataaaagtgcggtgctttcagcacttttttattttatgtttaacttaatttacaagtaacctttcgtatgggctaccactgtataaggattcacaatgccaattattactttacctgacggttcacaacgtcaattcgataatcccgtttctgtattggaagttgctcaatcaatcggttccggactcgctaaggctactattgccggtcgtgtgaacggcgagcgtcgagatgcctcagatatgattagtgaggatgccaatcttgaaattattactgcaaaagatgaagacggtttagagattatccgacactcaacggcacatttattagggcatgctatcaagcaacttttcccaaatgtgaagatggctatcggcccaactattgacaatggtttttattacgacattgatttggaccgctctttaacccaagaagatattgataccctagaaaaacgtatgctggagctggcaaaaacgaattatgacgtgataaaaaaacgtgtcagttggcaagaagcaagagatacttttgaaagtcgtgctgagccttacaaaatagctatcttagatgaaaatattgcaaaagacgaccaacctgcactttatcatcacgaagaatatattgatatgtgtcgtggtccgcacgtacccaatatgcgtttttgtcaccattttaaattaatgaaagtagctggtgcatattggcgtggaaatagtgataataaaatgctccaacgcatttatggtacggcttgggcagataaaaaacaattagccgattatttacatcgattagaagaagctgcaaaacgtgatcatcgtaaaatcggtaaggcattgaatttataccatatgcaagaggaagcacccggtatggtattttggcataatgacggttggacaatcttccgtgagctggaaacatttgtgcgtacaaagttaaaagaatacgattatcaagaagtaaaaggtccatttatgatggatcgagtgctttgggaacgtacaggacactggcaaaattatgctgatttaatgtttactacacaatctgaaaatagagaatatgccattaagccaatgaattgtcctggacatgttcaaattttcaatcaaggcttgaaatcttatcgtgatttacctattcgtatggctgaatttggttcttgccatcgtaatgaaccatcaggatctttacatggattaatgcgtgtgcgtggttttacacaggatgatgcacatattttctgtaccgaagatcaaattgaatcggaagtaacgagctgtattaaaatggtttatgacatttatagtacgtttggctttaccgatatttttgtcaaactttctactcgtcctgaaaaacgcattggtgaagatgtcatgtgggatcgtgcagagcaaggattggcaaatgcacttaaacacaatggtcttgaatatgaaattcaagagggggaaggggcattttatggaccgaaaattgaatttgcattaagagattgtttagatcgtgaatggcaatgcggtacaatccaattagattttgcgttacccggacgtctagatgctacctatgttgcagaagataatgcccgtcgtacacctgtcatgatacatcgtgctatcttaggttcaattgaacgttttatcggtattatcactgaagaatatgcaggttttttcccagcgtggttagcaccgattcaagctgttgtgatgaatattactgatagtcaagcggattatgtgcaaaaagtagttaagcaattttctgaagcgggattacgtgtaaaagcggatatacgcaatgaaaaagtcggtttcaaaattcgtgaacataccttacgtcgagtaccttatatgctagtttgcggcgataaagaaattgtggaaaacaagattgcagttcgtacccgtaaagggacggatttaggcacgtttagtgttgaagaatttgttgagattttaaaacaacaagtgagaaaacgtgagttaaccttgttaggtgaataatgataaaaaatataatcggcacttaaaggtgccgattttttatggaattgttcacttaatacagtaatgaatacaacaaacgacgaaatttatttgtaatcggatcgttattaccaatggcagctaaaatcgctaaaaattgttgcttagcctctccatttaacgcattaagatcttgttttaatatatcaaacagcaaatttaatgaagcctcattacgattggcttgatgcaattgtaatgctagttttaatgcaatttctgctgttggatttttagcaaaatcagcttgcaattgctgaatttcaggggtatcagtcgcttttattaaaagctcaatttgagcaattaaaccatgccagcgactatcacgatcttgtagcggaattttatctaaaatctcttgggcgggttcaatgcgttttatcgtaatataggtttcagcgtagagtagagcaatatcgctatttttcttatcagataattcccatgcttctttgagcaacggtagagcgtcattatattgttcttgttccaacaaatttaatgcctgattaaatttcatttcttcttccttcggtaaaattagagataaacgttgttgtaacataatttcatctaaagaaccttggaaagcatctaatacttgtgcttgattaaataaataagttgttggtaatgattgaatatgaaattgtgcggcaagcattttttctgtttcacaattcactttacctaataaaaattgtccttgatatttttctgcataacgagtcaaaagtgcggtaaattctaaagagattttgttacttggggtataaaaaattaaaacaagaggtgtttgtacagaactttgtaatacacttgttagattttgctcattaatatcaataatatatgacataaaatttcctacgtttatttaaaggtaaagtgggtaaattgtaacaaaccaatcattttttgggaaaatatttcttcgatttaagattttcttaatattttttaataatacaaaacagctgataaagaattcggtcaggatgctaaaatagatgtaacagaagtgcagaaattaataaaaaccttggtattgtttgatatgagactgatttaaaacgtcattataaattctccaaaatttaatcgctaaaatagaagatctttgctagaatccgtacgaaaaacacctttctaatgtttttcatttttgtcattaattcatttggaaacacatataatggaaaatcaatcttttctacaaaaatacttcaagtttaacgaaaaaaagacgactacaaaaacagaaatcattgcgggaattaccacattttttactatggtttatatcgtttttgtcaatccgtcgattttaggtgatgcaggaatggataaacaggttgtctttgtaacgacttgtttaattgccggtttgggaacaattgcaatgggattatttagtaatttacctattgcacttgcaccagcgatgggattgaatgccttttttgcttacgtcgtggtaggaaaactagggtattcttgggaaattggtatggggacaattttctggggatcggtagggttacttttactaactgtctttcaaattcgctattggctgatggcatctattccgctgagtttgcgtgtcggtatcggagctgggataggattttttattgctttaatcggctttaaaaatatgggactggttgtacctaatccggtaacgttggtttcgcttggtgacttacatagcccgcaagttttaatgggggttttgggattttttattattgtagtgttggctgcacgtaatatttattctggagtcttggtttctattgttactattacggctttagcattgatttttgatgaaaatgtggtttttaacggcgttatttctatgcccccaagccttgatgctgtagtcggaaaagttgatgttttaggtgcattagataccgcacttttaggcattattttttcttttttgttagtaaatttatttgattcatccggaactttgcttggtgtaacagataaggccggttttagtgatgctcaaggtcgtttcccaaaaatgaagcaagcgttatatgtagacagtattagtgctgtaacgggttcttatatcggtacatcggcaatcagcacttatattgaaagtggtgccggagtatctgtcggaggtcgtaccggaatgaccgctgttgtagtcggaattttatttttacttactattttcttctctccattggctggtatggtgccggcttacgcaacagcgggggcattagtttatgtaggtattttgatggcatcaagcttaattcgagttgaatgggacgatttaactgaagcaacatcagcttttattactgcggcaatgatgccatttacttattcaattaccgaaggtattgcctttggttttatcagctattgtgtcatgaagacttgtactggtcgctggaaagagattaatgcaccggtttgggttgtatctttgctttttgtagcgaaatttgtttgggttggataaatcattaattattgaatagatctttctaaagcggacattagtccgctttcttgttgatttaactagaattttgggatttttatggaacataaattagaagatattatttacatttttaatcgatgctttgagcaagagtataatacaaggttagttaaaggtggcgatgagccgctttatgttcctgccaataaagattgctcttataatgctatttatttcgcacgtggtttttatagtagtgctttacatgagattgcacattggcttattgcaggaaaagagcggcgaaaattagaggattttggttattggtatgaacctgatgggcgttcaatggaaaaacagcgtgaatttgagcaagcagaggtaaaacctcaggcattggaatggattttagcaactgcggcgggatttcgctattttgcgagtagcgataatttaaacggcaatccgggagatacacaaccttttaagttggcagtttatgaacaagtcagattttatgcaaaaaaggggttaccgaaacgagctgaaactttgcgtaaagccttagcagaattttataaaacagaagactgcattgatctgagtaaatttgacgtagcgagaatataaatgttagctttagaaattaaacaattgacaaaagaatataaaaatggggttaaagcactatccggaattgagcttagtgtagaagagggagatttttatgcgttgttgggacataacggtgcaggcaaatcaacaaccattggcatcatcagctctttaataaataaaaccagcggaacaataaaagtgtttggttatgatttggatcggcaattagctcaattaaaacggcatattggcttagtaccacaagaatttaactttaatcaatttgaaaaaattcaagacattctagtgaatcaagccggctattatggtattgagcgaaaagaagcacttaagagatctgaaatatggctaaaaaaattagatttatgggaaaagaaagatcaacaagctatgcgtttatcaggtggtatgaaacgccgtttaatgattgctcgagcattaatgcacaatcctaaactattaattttagatgagcctaccgccggtgttgatattgaactgcgacgtgctatgtggacttttttaaaagaacttaatcaacaaggaacaacgattattttaaccacacattacttagaggaagctgaaaatttatgccgtcatattggcattattcagcaaggtaaactgattgttgatatgtcgataaaagccttattgtcacagttagagacagaaacttttattttagatttagcactttctagttcaacgccaaaggttgataattacaacgtcacaattattgatgagctaacaatggaagttgaagttaagcgtgggcaaggattaaaccaactcttttctcaattaagcgaacaaggaattatcgtattaagtatgcgcaataaggctaatcgcttagaggaactatttgtttctatggcattaaataaaccaaaaatcacggagaaaatataatgttagcttggattgcgtttaaaacaattttaactaaagaaattcgtcgttttactcgtatttgggtacaaactttagtcccaccggtcattacaatgacactttattttattatttttggtcatttgattggatcaagaattggagaaatgaacggctttagctacatgcagtttatcgtaccaggactaattatgatgtccgcattaaccaattcctttgctaatgtggcttcttccttttacagtaccaaatttgctaaaaatatagaagaattactcatttcacctacttcttctcatattattattttaggatatatggctggtggtatagccagaggtttgtgcgttggtattttagtaacaatcgttgctatgttttttgtggaaatgactgtctattcatggctaattattgtgttgacacttttaatgacaacagcaacctttgctttgggtggtttaatcaatgccgtttttgcccgctcttttgatgatataagtattattccaactttcgttttaacccccttaacttatcttggcggcgttttttattctatttctttgcttccggaattatggcaaaacctatctaaacttaatcctattgtttatatgatcaatgggtttagatatggttttttaggtattagtgatgttgaaatttactatactttctttgttttggcgttattcattaccgcactttatagcttggcatattacttgattagtcgtggggtagggttaagaaattagccgtcagatcaatacaaacaaaggcgaataatcaatactcgccttacttttatgaacctaagttttttcctttaataaacaaataaatttgcaattgtttatatttgatctatttaggtagttttccttgattttctatttcatagcaaggttcataagcatcacctccaggtaatttcattctgtgctggttgatgaaatcttgcaataaattgtcgactttttccattaatacgggatcaccttttagtttgaattttcctaattctgcaattttatcttgagtatccggtttgatatttcccgctacaattcctgagaaaactcggcgtaaattagcagctaaatcaactttagattggtcaaaatgtaaagctaaatttgccatgttttcatgagttgggataaacggtttttgaaattcagcagtaatttctaatgaccagttgaaataatacgactcatttttttcatagcgtgattttttaatatcacttatggtttcgttcatgtgacgagcaaccgacacaggatcatcaataataatttgatataaagattgtgcatcttcccctaaagtgtcaccaatgaattgatcaattgaagcgaaataatccgcactttcttttggtccggttaagattaacggcaacttttgtgcattattggcagggttaagtttaatacctaaaatataaagtaattcttcaaaagtaccgggaccgccggggaaaataataattccatgtcccatacgaacaaatgcttctaggcgtttttcaatatcaggcatgataatgagttcatttacaagtggatttggcggttctgaagcaataatagacggttctgtaataccaataaaacgactttgtttataacgttggttcgcatgaccgatagctgctcctttcatcggtgcctccatggcacctgttccgcaacctgtaataatatttaattcacgaagcccaagctccaaccccacagcacgacaatattgatattcaatttgattaattgaatgtccgccccaacaaacgactagatttggttgttctccattagtgaaagcctttgcattacgtaaaatagagaagacttggttagtgatatgtttactgtcttgaatatcacaagggttaatgcgttgatttaagacattaacaaataaaatatcacgcagcacagcaaataaatgatattgaatatttttaatcattttattatcaacaaaagcatttaccggtgggttatgcaactctaaagcaatgccacgttctcttgctaccaaattaatatcaaaatcggaatattgatttaacaacgcacggctgtcgtccgtaattgcacctgagtttaatacggctaatgaacaattgcgataaagttgataaagcttacttttagcttttttggttaattgttcaacttccatatgtgaaagttgatccatacttcctttgggattaacataatgtatatttttcataaaagttcctttttattggcgtgcaagacgctggttaagcggaataggctcaaaattggaacgaaatggattaatatccaatccgcctcttcgtgtatatcgagcataaacactcagtttttcaggttgtgcaaatttcatcagatcacagaaaatacgctctacacattgttcatgaaattcattgtgttgtcgaaaggaaataagataacgcaagagtttttctctgtttatttggttaccaatataatgaatttgcacagttccccaatccggttgattggtaattaggcaatttgatttcagcaaatggctgactaatttttcttcgacccattgcttgttggtgcaattttctaataaatttggatcaaattcatagcatagtatttcaatatcttgttcatcaatacattcaccttgtagagtagcgatgggttgttgagcataattctgtaacgaatttaaccgcacttttacttgcccttttgcacattttattaaatcttgttgcagtatttgttcaacctgttgtagattttcaaactgactttgattaaaactatttaaataaagtttaaaactttttgattcaatcagattttcactttgataatcaatttcaacatcagcaatagcaacttgaggaacaccttttaaatttagccaagaaatttcataggccgtccaaatatccgcaccgaagctaaagggctgttttgtactaatacctaaatcatctcggttaagtttgcgtggtaccgcttgtaataaagtgcggtcgtaagtagagatatattctgttttttttcctaattttaatgtttgtaaactttggtcatggtattgcatgattcgtcctttttgttattgccaatgccaagataaattggaaactaggcgacaatgatcacatttaaaatgaaagaggttaaataacggtttatctaaatgccatttttgctgacaattaggacataagcgttgttgttcactttgcagattatcaccgccaatgcgataaagataataaaaagtggggataccggtatgtttttcaatttcttgagtcagataatagccgtgtttagttaaatgactattgaaatcactgatttcatacagtgcttgttgctctaaaattgaaccgttcatttgcaattgatcacaagcctgccaattttcttgccatttaataatatccatactcaagtgcggtatgtttttaaattgtttatataatggaatgggcaataaattatcaccgctatgtagcggagaacaagattgcaaatacgttgtatacagcacttgccaagtcgctacctcttttgggtaagttatatctgaatttaaatcatccgcaatgatttgaaaactatcaaaaaaaatccccgcactttttgcttgttcaagggctttatctacttgtatgttattgaatgtaggtaacaaactttgctgttctggacaagttactcgcaatgcaaatccctcttcattattttgaactgcaacaaataatggaatttcacgtccaataatttgtccgttataacgccattgctcaataatttgattaattagataagaaatattactaattggcaatttttgaggttgtcgataggtaaaaaatacttcaactagatacatatttattgtttgatgattattcgaaagggtagattaacataattaatttgcatagaataccgctttttattttggaatataacgcatgaaaattgaaatcaaaacgcacttaaaagcgttacaaaaaattatgcaagacttagaattatggcaatcctttccgcccgatgaacaggctttttcaagcaccgcccctttttctatggatactatgagtgctaatgaatggttacagtgggtttttatccctcgtatgtatgcgttgctggagagtcaacaatctttaccgtataaaatggcaattacgccttatatcgaagaagcattaaaagatcttgatggattaaatgacctactacagcctattcatgaaattgagaaattatgtcagagccaatagaattggatattttatatcaagatgagtttctcgttgtagtgaataaacctgccggaatgttggttcaccgcagttggctagatcgtcatgaaactcaatttgtcatgcaaactttacgagatcaaattggtcaacatgtttttcctattcatcgtttagatcgtccaacatcaggtgttttactttttgccttaaatgctggaattgctaatttattatgttcacaatttgaattaaaacaagtgaaaaaaagctatttggcgatagttcgtggttatttgagcgatgctcaacgaattgattatccgcttaaagtgcaactggacaaaattgcagataaatttagtcgaaaagaagaactgcaagatgcaataacggattattatggtttaaaaaccgttgaaatgccttatggcgtagggcgttatagctcttcccgctattcacttgtacgtttaatgccttatacgggacgtaagcatcaattacgtcgccatttaaagcatatttttcatcctattttgggtgatactcaatatggtgatttacaccaaaatcgggctttcagtcaaaatcttggtgtaagcaggttaatgttacatgctgaaaaactttgttttcaacatccggtaactaatgaaacaatagaaattgttgctgatttagatgagcaatggaaattgttattcaaaatatttaattggtaaatagctcagaacatttgaggaagtatatgttaaataatgtaaaattaactcatgaagaacagcaaagtgcggtagaaaaaattcaagaattaatgcgacaaggtatgagtagtggggaggctatagccttagttgcgaaggtgttacgtgaaaaaaagttacaccctgaatcaaaatataatgaaattttgtgatctctgtcggatttttgaatattatttattgcaaatatagttaatttcgttgagtatttagttaaattttaggaaggtggtaaggctcacagtcttattatgaagtatagaggtctgtaaaggcttaaaaccaaagaggttaaaatattatggaagtaggtattgttaagtggtttaataatgcaaaaggatttggattcctgtctgttgaaagtagtgatgttgatgtttttgcacattattcagtcattgaaatggaagggtatcgttctttaaaggcgggacagaaagtacaatgtgaagtcgtgcatggagataaaggttctcatgccacaaaaattatccccatggttgaataataaaatcaaagctttttgtttcggtgtattgagcaaggttttaaccttgcttttttatgtgataaaactcgctattttagcagatctttaagaccttctttcataacggaaacttgattttcatataagaccttgctttctctttcatcaatcatataagaaatagtttccgataaagtcattttcattttacgtgaataacgagataatcgaagccagaccgcatattctagatcaattgattttttctttgtagattgtttctcgccattgaaaaaacgttttcttcttgctcttatagcttgatccaacttaataactaaatttgatgacaaatgattttctatccaatcttcaattttttcagggtagttttggtgtgtcattaattgccgaacaatgtcttcttgtaaactttgttctgtataacgtgtaatattttcaccctcgcgtgattttttgatcaaatagagccatttccaatttgcttcttgatttgtcagcttctgatatttcattttgtttactcatctgtgacattgtaacctatgtaataatatacgctttttatattattttctagtaaattttaatcaagaatacagaagtgaattaaatagaaatatgcgataatatgaccttaatcgtttaatttgatagagagtacatgtgacaattgagcaaaaaataaaaaaaagagccgacgaatgcttgtcagaacagttaatttcttggcaaaatttattacccatgttacaacttgataatgattttttagacgcttcattatctgagattgatttttttactttgcaaccaagagctaaaagtgcggttgatcttttcctaaaaaatcctcaacgatcattgcttgttttaaaagcagatgatcaagctgaatatgcaactttactacaagaatatatagaacaaaaacttcctgtttctgaaacaattagtggtgttcagtatattattgaacagggagacagtttttcttttccacaaatcagtctggcacaggcagcatcagtggaagacaactttgcaggaaaacaaaaagtggcgagtgctttatttttcgatcaaagtcagttattcggatcagttgtaattcatcccagttctcatgatattcaacttaattcaggattagtacatcaagtaaataatggtgtattgattttgagtgccggtgcattgttggagcaatttgagatatggcatcgtttaaaacacttattactaacaggtattttcagttggtattctcttaatcctttgaaaacattaccttgcacaattcctaattatcccctaaatctaaaagttatcattttaggtaatcgttcagagttggcaaccctaggtgaattggaggaggaactgtatcatttcgcagattatgcagaaattgaaagttatttttcgcttaatgatgcacaatctcatcaaaagtgggcaagttatgttcatacgttggcaaaaaaacaaggaattgagctgagtattgaaggaataaatgcactttatcaactttttgtgagagaaagtgaagatcgttacttaattagtatctcaccattaaaattaaaagggatcttatttgacacacaaattttaagtcaaagaaaacatttaagtgcggtagattttcaattattttttcaacaaaaagaacaacagtactgtttcttacgtgagcaggcgtataaaggcattttacaggagcaaatttttattgctacagatggggaaataataggacaaattaacggattatcagtcattgaatatcccggtacgccggtttcttttggcgagccttcaagaataagttgcattgttcaatttggtgatggtgaagtaattgatattgaaagaaaaagtgatctggcagggaatatccatggcaaaagcattatgattgcagaaacttgtcttgccggcattttagatcttccttctcaattgcctttttcagcctcaattgcatttgagcaatcttatggtgatattgatggtgatagtgcgtctttggctgttttctgctcgttattaagtgcgttggctgatttgccgttaccacaaaatattgccgtaacaggtagtattgatcaatttggtttagtgcatgctgttggtggtgttaacgataaaattgaaggcttttttgaagtttgtcagcgtcgtagattaacgggaaagcaaggtgtaattattccaagtgcggtattaaatcaactcagtttatccagtaaagtaatcgaagctgttcaacaagaaaaattctttatttgggcagttgacgatatttttcagactactgaaatcctatttaagcgatatttagtaagcgaacaggatgctggattggaaaaaaatcttcccctcgtagatgtgattcgacaacgattagaagagagatctgaacaacagcataaaggtcgtttttggaactttttctttaatcgccattaaatgttaagaaacacgtgattttttaacaggttagtattattattaggggcattttcgtttaaacattggatttttaattatttagaggacaggtatgtataacctacaagaaattactgaagaagcacggaaagcaattgaggcactgcaagataagagcattgaaagcttggaggcaattcgtgtggaatattttggtaaaaagggacattttacacaattaatgcaagggttacgtgatgtgtcggcagaggaaagaccggcagttggtgcaaaaattaatgaagcgaaacagaaagttcaagcgatattaaatgcaaaaaaagtggaatgggaagaaatagcgttaaatgaaagattagcccaagaacgaattgatgttagtttgccgggaagaaaaatggaactgggagggttacatcctgtttcaattactattaaccgtgttgtacaatttttttcaaaactaggatttactgttgagataggtcctgagattgaaacggattattacaattttgatgcgttaaatattcctaaacatcatcccgccagagctgatcatgatacattttggtttgatgcagaacgtttgttacgtactcaaacttcaggagtacaaattcgtactatggaaaaaatgtgtcctccaattcgtattatggcaccgggcaaagtatatcgtaatgattatgatcaaacgcatacgccaatgtttcaccaaattgaattattgtatgttgataaaaaagctaattttactgaattaaaagggttgttgcatgatttcttgcgagctttctttgaagaagatttacaagtgcggtttcgtccatcttattttccatttacagaaccttcggcagaagtggatgtaatgggaaaaaatggtaaatggcttgaggtgttgggttgtggtatggttcacccgaatgtgttgcgtaatgtgggtattgatccaaatgagtattcagggtttgcagtcggtatgggagtagaacgtttaaccatgttacgctacaacgtcacagatttacgttcattttttgaaaatgacttacgttttttaaaacaatttaaataataagggcaaaaaatatgaaaaaattaatatcagtcgcgttggttatgttttccccttttacattcgctttttcacagggacaagttaaattgcctatgcaggaaaaacaaccggcagcagtcattcgtgtatttgataattcggttaaaccctataaaatcattgaaggaaagaaactatctcgtagcaaaccacgtcatctttgtttatatatacttaatgtcgatcttcaggaaagaaatcttttagctcaatatgtacaagctcctgcaccgataaaggtaaatgtgccgaatgttaatgctaaagtacgaatggaagataaccagaagaattttttgattatgtttgacatgatgaaaaaagatattagaaataatacacctactctatgttgggcacttggtacagatgaccctatcggcatttacaaattggatgtgcaatttaataatgttgtgtttgaaaacttagaatttgaattattaaaatagagagagaattataaatgaagtttagtgaacaatgggtgcgtgaatgggtaaatcctgcaataagtactgaacagttatgtgaacaaattacaatgttgggcttagaagtagatgatatagcaaaagtcgcagcagatttttcaggggttgtcgttggtgaagttgtagagtgtgctaaacatccggatgcagacaaattacgggtaaccaaagttaatattggtggcgagcgtttattagatatagtatgtggggcaccgaattgtcgcaaaggattgaaagtcgcttgtgcaatagacggggctatattacctggtaattttaaaattaaaaaaactaaattacgtggtcagccatcggaaggaatgttatgctcctttaacgagcttggtattaatgaggactccagcggtattattgaattaccgcaaaatgcaccgataggtgttaatttacgtgaatatttaactctgaatgataacaatattgaaattagtctaacaccaaatcgtgctgattgtttaagtatagccggaattgctcgtgaaattggtgtagtcaataaacttgaactaaactcaccgcactttgaaccggtcaaagcaagtattaaagataaagtcactattgaagtattagcacctgaggcttgcccacgttatcttttacgtgtggtgaaaaatattaatgttaaagtcgacacaccgatgtggttacaagaaaaattgcatcgttgcggtattcgttcaatcgatcccgtggtggatataactaactatattttgttagaacttgggcaaccaatgcacgcatttgacatggcaaaagtgactcaacctgtacaggttcgtatggcaaagcagggggaggaattggttctattggacggttcaacagcaaaattgaaagaaaatacgctgataatcgcagatcaagaggggccgttagccatggcaggcatctttggcggacaggcaagtggtgttaatgcagaaactaaagatgttattttagaagcggcattttttgcaccattggctattgcaggacgtgcaagacaatacgggttacatacggattcttcgcatcgttttgaacgtggtgtggattttgaattggcacataaagcaatggaaagagcaaccgcacttttaattcaaatttgtggcggtgatgccggtgaaatttgtgaggctttaagtgaagcacatttaccaaaagtaaaacaaattcagctacgtcgtacgaaattagataccttacttggccatcatattgaaacagaaaccgttactgatatattccaacgtttaggatttgcagtggaatatgcgaatgatgtctggacggttacttctgcaagctggcgttttgatattgaaattgaagaagatttaattgaagaggttgcccgtatttatggttacaatgtgattccaaataatgcacctttagcacatctacaaatgaaggaattaccagagaaattattagatctcaatcgtatccgtaccgcatttgtggacagcgactatcaagagattatttcttatagctttgttgatcctgacatacaaaaattgttacacccagaactagatgcacttgtattgccaaatccgatttcaaaagaaatgtcggcaatgcgattatcgttattgccgggcttgctgagtgcggttgcatataaccaaaatcggcaacaaaatcgaattcgtttgtttgaggcaggattacgttttattcctgatactacagcagaatgcggtattcgccaagaatatgtgattgggggcgtaattgttggtgataaacgtcctgttcattgggaacaaaaaggtgaacatgttgatttctttgatttaaaaggtgatttagaacatattttgtctttaactcacgttggacatcgtttgcgtttcgtggctaaatcttatccggcactacatcccggacaatcggcagaaattttacttgataacaaagaaattggttttatcggtacagttcatccaaaaattgtacaaaaattggatttgtccggaaaaccgattgtattccaaattgaatggaatgcgatttctgagtgtaatgtccctacagcacaagaaatttctcgcttcccagccaataaacgtgatcttgccattgttgtagacgctgacgttgtggctggagaagtactggaagtttgtcgtgctgttggaggtaaacaactcattaatgtaaatttatttgatgtttatcagggggtaaatctacctgccgataagaaaagtttagcacttagcttaatgattcaagatacagagaagacccttgaagaaaaagatattaatgcggtaatatctgttgtattatctgcgttgcaacaaaattttaatgcttacttgagagattgattatggcactgactaaaattgaacttaaaaatagcttgattgaacagggtttaaataaattagaggcgaagaaagtagtagagggcttctttgaacaaattcgagtttcattagaaaatggtgaagatgttaagttatccggatttggtaattttgaattaagagataagtcatctcgcccgggacgtaatcctaaaacaggtgaagctattcctgtttctgctcgtcgtgtcgttgtattcagaccaggacagaaattacgttcaagagtggaaaaaaccaaacctaaaaattagggattttttgtttctttaagaaaagccgtttacattaagtaaatggcttttatattttaacgtaatagaaaaggtataatggacaaaatagttgctaaaaagtgcggtcagtattttatttttttacaccgcactttcttaccttaatttacctctttgaaactaatcatttcgccttgaataaaatctattttttcatcgttttcttgaacgaggggagtaggtgagaatgcttctttatcaaaggcaatatcaccttctattccttccggaatctttccatgtcggatacgtttaaaatcaaataagttagaatcacataaatgtgaaggcactatattttgtatcgcactaaacatagtttcaatgcgtccgggatattgacgatcccatttttgcaacatttctttgacaacttgacgttgtagatttggttgagaaccacataaattacaaggaataattggaaattgtttggcaactgcatatttttcaatatctttttctttacagtaagccaaaggacgaataacaatctgtttgccatcatcactgatcagttttggcggcatagattttaatttgcccccataaaacatattcaaaaacaaagtttccagcatatcatcacgatgatgtcctaaagcaattttagttgcccccaattctgttgcggtgcggtataaaattcctcgacgtaaacgagaacagagagaacaagtggtttttccctcaggaattttttcttttacaataccatatgtattttctgccacaattttgtaatctacactaatgctttttaaatattcgggcaaaatatgttcaggaaagccaggttgtttttgatccaaattcactgccacaatatcaaaatgaataggtgcattgaggcgtaaatttaataaaatatctaacaaagtataactgtctttaccaccggataggcaaaccatcactttgtctccattttcaatcatattaaagtcagcaatagcgttgcctacattgcgacgtaatcgcttttgtaatttattcaagttataactttgttttttatctttttcggtaatgatatttaaactcatacagtttctgatcttgttaagaatgcgatatagtaaaggggaattgccactttgccaacagaaaactgtgtttttaatgatctattatttaaattaagtacgagataaaagtgcggtagtttttagtcatatatctattagaaaaagcaaaattacgctataatcttgcacaattttgcgtaaattattgcattgtgagaattgttaatgctcgaaacatcacaaactattcctgaattagtcaactggacgagagaacgagagttttctttgagtctatctacagaacgcttggcgtttttgctggctattgctatttacaataatgaaagacttgacggtgaaatgttggaaactgatctcattgatatttttcgccatatttcaaacacgtttgaacaatccgctgaaactgttagtacaagagcgaataactccatcaatgaattagtgaaacaacgttttttaaatcgctttagtagtgagtttactgaagggttatctatttatcgcttaactcctttaggtgtaggggtatccgattactatattcgccagcgagaattttccgctttacgtttatctgttcagctttctattgtagcagatgaaattcaacgagcttcagaatctgcggaagaaggcggtgatgaacattattggcgtaaaaatgtatttgcaccattgaaatattctgtagcggaaatctttgatagcattgatttatctcaacgtatgatggatgaaaatcaacagcatatcaaagaggaaattgctgaactgcttactaaagattggcaaacggctattgccagttgtgaacgtttattagatgaaacctcgggaaatttacgtgaattgcaagatacgctcaatgctgccggcgataaattacagtctcaattgttacgtattcaagactgtgtaatagggcatgacaatttgtattttgttgagcaacttattgtagatttacaagcgaaactcgaccgcattataagctgggggcaacaagctattgatttatggattggttacgatcgccatgtacataaatttatccgtacagccattgatttggataaaaatcgtgtcttttcacagcgtttacgtcagtctattcatcattattttgatcatccttggttcctttggatcgcacaggctgaacgcttaattgatttgagggaagaagaattaacattacgtgaagaagaagcccttggggaactgcccgaagaattgcaatatgaatcccttgctgatttacatgagcaaattgtggaaacaatgcaatctttattaattgaatatcgtctacaaaatacccctattgatttgagtgaggttttgaccgctcaactaaaacaatacccacttgctaatcattttgatatagctcgtattattattgatcaggccgttcgtttaggtttagctcaagatgatttaaacggtatttatcctaattggagatcgattaacgaaaatggtgcagaagtacaggctcatgtaattgataaatattaacccaatttaaccgcactttttgtaactgattaatttaacaactttctgaaaagaaaagagaaaaatatgacagatagtattcaagatttactttccattaaattagctagagctattgcaaatcctttattccctgaagtggatagccaattgcgttcaggtaagcacattggacaagagtatttagataattattcatttttggcagattttcaacatgaattagatagtttctaccggcgttataatgtggaattgattcgtgctccggaaggatttttctacttacgtccaaaagcaaccacgttaattgctcgctcagtgttgagtgaattggaaatgttagttggaaaagtgctttgttacctgtatctcagtccggaacgtttggcacaacaagggatttttactgttcaagaagttcatgatgaattgatcaacttggctgatgaaactaagttattgaaagcgattaatttgcgtgcaggtggttctgatttggataaacaaaaattagcggaaaaagttcgttcagctatcagtcgtttacgccgtttaggtatgattcatgcggtaggcgatcaacatagcggtaaatttacgatttctgaatctgtgtttcgtttcggtgcagaagttcgttcaggggacgatccgcttgaggctcaattacgtttaattcgagaaggggaagcggcaacggctcaatcattacaagaagaaaaaaatggcttgaaagataatatggatcaaagtgcggtagaaaatgaacaatattttgaaaatgaagaaaatgaggggattgcataatggtagatttagcgttacagccgaccatgtctgaagaaaacattgatcaagttgaactacaggataaacaagaatccctcgaaaattttacggcattttcgccttttcgttctcaggggggagtggagcgaggtaagtttcgttctttaaccttaattaactggaatggtttttttgcccgcacttttgatttagatgaattagtaactacgctttcaggcggtaatggtgcaggtaaatctacaacgatggcaggatttgtaactgcacttattccggatttaactttattacatttccgtaacaccactgaagccggtgcaacaagcggttctcgtgataaagggttacatggaaaacttcgccccggagtttgttatgcggttttagatactattaattcacgtcatcaaagaactttagtgggagcaagattacaacaagtggcaggtcgtgataaaaaagtagatattaaaaccttttctgttcaaggcttagcattatcacaaaatccaaccgcacttttcactcaaataattgatgagcgtcaagcgaggatattaaatcttaatgaattaaaagacaaagttgaaaaactcaatgctcaattcaaacaatatcattcaataacagattatcatgcgatgatgtttgatttggggattatcccgaaacgtctgcgttcttcttcagatcgcagtaagttctacaaattaattgaagcatctttgtacgggggtatttcaagtgccattacccgatcattgcgtgattatttattgcctgaaaatttgggggttcgtaaggcttttcaggatatggaatcagctttacgtgaaaaccgtatgaccctagaagccattaagattactcaatctgatcgtgatttatttaagcatttaattactgaaacgactaattatgtagcatcggattatatgcgtaatgtcaatgagcgtttaggtaatattcaacgtgcgattaattttcgtcgagattggtataaagcaaaaggtgagcaatatttatcacaacatcgcttagtggaattgagtaaagaagctgctgatttggctgaaaatgagaaaatcttagaaatagatcatcaaagtgcggtagatcatttgaatttagttctaaatgctttacgtcatcaggaaaaaattgaacgttatcaacaagatgtgcttgaaatcacagaacgtttagatgagcaaactttagtcgtggaaaatgcgaatgagcaggtaattgacactgaagtacagttacagaatgtagaaagtgaattggatcagattcgtaatcaattagcggattataagcaagccttagatgcacaacaaactcgtaatttacaatatcaacaagccatacaagcattagaaaaagctaaacatttatgtggattacctgatttagctgttaaaaatattgacgattatcaccaagagtttgcggttcaagctgatcaattaactgagaatgtactggatcttgagcaaaaaatgtctttgacgcaagttgcaaaaacacaatttgataaagcttatcaattggtatgtaaaattgccggcgaagtacctcgttcagcagcatttgagcaagctaaggaattgttgagagagtatccgacacaaaaaatacaagctcaacaagtctctcaattaagtgctaaattacatgagcttgagcaacgttatcaacagcaacaaagtgcggtacgtttattaaaagaactgaatcagcgtgcggatttacaggtcgatgaagcagaacagttggaagattattatgtagaacaagaaacattgattgaagatttaaccgacaaattatcagagcaaatagaaaaccgctctgtcttgcgtcaaaaaagggatcaactaaccgcacttcatcaagaaaatagccaaaaagcaccggcatggctaacagcccaagccgcattggagcgtttacaagaacaaagtggcgaacattttgcagatagtcaagatgtcatgaatttcatgcaagcacagttgattaaagaacgcaacttgacgattgaacgtgatcaatttgagcaaaagcgtcagcagttagacattcagatttctcgtttaagtcagccggacggctcagaggatgctcgtttaaatatgctggcggaacgtttcggaggtgtgctgttatctgaattatatgatgatgtacctattgaagatgcaccttatttttctgcgttatatggaccggctcgccacgccattgtagtacgagatataagtgcggtgaaatctcagctggataatttggaagattgccctgaagacttgtatttaattgaaggcgatccaaccgcatttgatgacaatgtattggattcaaaagaattggctcatggggtagttgtacagatttcagatcgtgagttacggtattcgaaattccctgaagttcctttatttggtcgagcggctcgagaaaaacgtttagaagaattaaatattgaacgtgatgaaatttcggaactttatgcacaaagagcttttgatgtacaaaaatgtcaacgtttgcatcagcattttagccagtttgtcgggttgcatttggctttagcatttttacctaatccggaacaaactattgctgaaattaatcagcaacgcaatgaagtagatcgtgaattaaatctacttaacagtacagaacaacaattgcgtcttcaattggatcaagccaaagaaaagtggcaattacttaacaaattaagaccgcactttgctctattggctgaggacagtttaatagatcgtattgaagaatgtcgtgagcaactggattttgcacaacaagatgagttgtttattcgtcagcatggtgcgaatttatcgcaacttgaacctattgtaagtagtttacaaagcgatcctgaacattatgatcgtttaaaagttgattatgacgaagcagttattttgcaaaaaaaagtacagcaatgtttgtttgctttatctgatgtaatgcagcgtaaagctcattttgcctatcaaaatgaagttcaaaccgaaacttctgatttgaatgagaaacttcgtcaacgtttagagcaaacgcaacaacagcgtaatgatttccgtgaaaaattacgtcaaaagcaagaacaatttgcccaatataataaagttttaattgagctgacatcttctttgcataataaacaacaagtactaaatgagttgttacaagaagtaggtgatcttggtgttagagtagttcaaggggcagagcagttggctcaatctcgtcgagatgagttatatcaacaactttctatcactcgccaacgtcgcactcatgtcgagaaagaattaactcgaattgaaagcgaatcgcaaagcttgcatacccgtattcgcaaagcggaacgagaatataaggctcaacgtgaaacagtagtagcggcgaaaattagctggtgtgtggtgatgagattatctcgtggcagtgatgtcgaaaaacgtctaaatcgccgtgagtttgcttatttatctgccaatgaattgcgttctatgtcagataaagcccttggtgcattacgtcaagctgtagcggataatgaatatttgcgtgattcattgcgaatttcagaagatagtcgcaaacctgaaaataaagtgcggttctttattgcagtttatcaacatttgcgtgaacgtattcgccaagatattcttaaaacggacgatcctattgatgctattgagcaaatggaaattgaacttaaccgtttaactaacgaactgactcaacgagaacaaaaattagcgattagttcagaaagtgtggcaaatattatgcgtaagacaattcaacgtgaacaaaatcgtattcgtatgctaaatcaaggtctgcaaaatattgcttttggacaagtcaaatctgtgcgtttagtagtgaatattcgtgattctcatgctatgttgctcaatgccttatctaatgaacagaccgaatatcaagaactctttacggatactcgcataaccttctccgaggctattgctaagttatatcaacgccttaatcctcatattgatatagggcaacgtaccgcacaaacgattggtgaagaacttttagattatcgtaattaccttgatttagaagtagaagtctatcgtggtgcggatggctggttgcgtgcagaaagcggtgctttatctaccggtgaagctattggtacgggtatgtcaattctcttaatggttgtacaaagctgggaagaagaaagtcgccgtattcgaggaaaagatattattccttgccgtttgttattcctagatgaagcagcacgtttagatggtaaatccatctcaacgttatttgaattgtgtgagcgtttagatatgcaacttctcattgcagcacctgaaaatattagtccggaaaaaggtacaacgtataagttagttcgtaaaatttcaggcaatcaagaacatgttcatgttgtcggattgcgtggatttggtgcaacagagtagtcaaataaaagaaagtgcggttaaaaataagcaatttttgaccgcacttttttgaggaaaataatatatgttggttttccaaaaagaaaaaacacaaaagctctctcttttagaggaaataccttttaaattggaaaaggacattcaacgtctttttgaacaaaatctatcagaaatcacatcttatgatttggtcaaatccgaattttcaattaaaaattatcgcattgatacattagcttttgacgaggaaagtaattttttgttattattgaatataaaagaaatcaaaatattagtcttgttgatcagggaatttcttatcttagtttaatgcttgataataaaggtgagtttattcttgaatataatgaaaaaaatgaaacaaaatcattaaaaagaaatgaagtaaattggtctcagtcaaaaattatttttgtgtccccatcatttactgattttcaaattcaagctacgaattttaaggatttgcctattgagttatgggaaataaatcaattcaatcaagatattataactatcaaacagattaaaaaatccaaatctgcacctagcgtaaaacagattaaggttacccaagattcatctttagataaattaacgaaagagattaagatttatacagaacaagaacatcttgaaaatcaatctgatgaaataaaagaactctacgatgaatttaagcaagctattttgaaattagatagtgaaatagaaatagttgccaaaaaagtttatatcgcatttaaaaagaaatctaatattgttgatattcaaattaagaagaaaaatttaaaactatggatcaatttatctaaaggaaaactagatgatcctaaaaaactagcagttgaagttgataaaaaagggcatcatggtaatggagattatcaattaatcattaaaaatactgataatattgaatatattatgagtttagttaaacaagctgtttaggagaaataatgtattatctaattcttgctattttttgtagtgtttctgtttccattttatttaaattcaccaaaaaatatcaaattgtaaccgcacaaatgattgcatttggttatgtggttgccttgtcattgagctattttttattagcacctaattttaagggacttacttttaccgaattttttgcacaaagtgaagctaagccgatctttatcagtttagggattttattgcctgtcggttttttagtgatgtcgaaagcagtggagtatggcggtattattcgcacagatgctgcacaacgtttggcattgttcttgcaaattatcgctgcagttgtgattttcggtgaaaccttaagcgatatgcgaattgtcggtatcattgtcgcatttttcgctttatttttcctattaagcaaacctgccggagggataaaaagtgcggtcaaagccgcttttgctcttgccggcgtttggttaatttggggagcaacagggattttatttaagaaaattgcactaatgggcggtgcatttcctacaaccttgtttatcacttttgtcctagccggtgtgattatgtttatctacctattaatcaaacgcactaattggacagtatccagcctgattggtggcattattttaggttgtttgaatttcggtaatatcctgttttatatctacgcacatcaacatttcaaagaaaatccaaccattgtttttgccacaatggatctcggcgtaatctgtcttggtacattagtaggtgcaactatatttaaagaaaaaatcagcaaattcaatggtattgggatcttattaggtcttgtcgctattttgttgttacgggtttaggggaaaattaaatgataatcagcattcaacaacgttctgaactccatcgccaaatttggcaaattgcaaacgaagttcgtggagccgtagatggttgggattttaaacaatatgtattaggcacactgttttaccgctttatcagtgaaaaatttgagaaatataatgactgtgcttttgagattattggatatttagcagactggggcagctgttcgagtggtgcttatcatttttttgattattataggcaaaaaacagcagaagaatttaaagaatgtgtgatgagagaacttacgaaaaattacgaagaaaaccctgatgtgagaacaaaaatgacagttgcagaaatagaaaaagagtttctgactcgtctatgaacaaggtagttaattaagttttaaaagagggaaaaagaggactttattttaaataaaactacttattcttcataaattatggaaaccaatatttcaaaggagaaggactatgcaaataacaaaagaagcatttaaaacattaagtaataaaggaagattagaagttattcaaaaccttgattggtggtctgatagagataaaatattagaattattattgtcagttgatattagtacattggatagccgcttactttcagaactgggaaaagtctataacaataccttcgagtatgaaaaagcggtctcagttttggaaagggtagcagaagacgaaagagattcatcatggtattatcgctatgcttattctcatagtggattggcaactgagtctaactatgattttgaaaccgaagtgaaaaatgcacttgaaaagcttgaaaaagcgatcaagatttctaatgatgaagaaacaatcagatggtgtttagaactggtagatttaagcaattttgaggaaattctaggaaaaaacaaggagaaatatcctattttaacagagaaatactttgaatatatcaaacaagaaaatgaaaaaatagaggaaacaattgagatggctcaagcacaaaagaaattaaagtatgtaaagtttaccgtagaagatatcaaaagtgtagcagagaacgattctaatgatgatatcgttgaaccgatgtgggaaacaattaacatttatgatggatatgagaagtatcttcaatcagcaaaggattttactttagagcaaagatatttattagccattaatcggtattttgtagaagtaaataatggaggtcatcaccagtttttctataattctacagggatcgtttgggaagatgctctaaatggtttaaaacatttcggaatgaacgagtttgcagctaattttcagaaagttatagactattgtggtgggacaatatcttttgatagagaagaaagatgccgtatgctagagatattagaggaaaatgaagaggaattttataaggtcttagatgaagcagatgactttgtttatgagtatgagggagaagaaaatgaactaatttacatcaaaaatcatccaaagaaatttgtatttgaaggaaaatattggacatacgacattagaagttagcgagcttagcaagttactagtctttatgttatgcaagctataaattttgtacgaatactgcatggcagacaattagaatttgtaaatttgaatttggaggtaatataaaatgggaatgatagccaattatcaatatttaagcaatgaaaatttgcggaaaatgaaatcctttaatgaagaaaacgatgagatttttgaagaactctaagataggaatgaagaagcaaagatacttcttgatttagataagatgtgggatgcacttcattttgtacttacgggagtgaacagtcttgaaccaatagagaataatcctctcagtgaagcagttgtaggcgtatcgtatgcgaaaatggtacagatttaaatgatattttgccgaaaatgagtccgcttaacccacaatataaaatgaaaaaacagacggtgtttgagaagatttccgcctttgtggaaaaatttaaggggattgggggaatgttttaatgaattctacaaagtgcggtaagttttttaaggtttttgtatatgcaaaatgatttcagtttttttatctacgattacgaaagttttgggattaatcctgccactgacagaccggctcaattcgctggtattcgtacagatcaagattttaatattattggcgagcctgtaatgttttattgtaagcaaaccgatgattatttaccgtcgccggaatcggttttggtaaccggtattacaccgcaaatttgtaatgagaaaggtattcccgaaccggaattcgcagagaaaattttagctgaatttagtcaccccaacacttgtattatggggtataacaatgtccgttatgacgatgagatgacacgttataccttttatcgtaactttattgatccctatgaatacagttggaaaaacggcaattctcgctgggatttaatagatgtagtccgagcttgttacgctttacgtccggatggaataaattgggcttacgatgatgatggaatgccgagttttcgtttggaaaaattaacacaggtaaatggtatagagcatggtaatgctcatgatgcaatggctgatgtctatgccacgattgcaatggcaaaattgattaaacaaaaacaaccaaaactttttcaatttttctttgaaaatagaggaaagagggaagttgagaagttgattgatatcgctaatatgaaacctttagtacatgtatcaggcatgttgggtaattatcgaggtaataccagctgggttgtgccattagcttggcatcctataaatcagaatgctgttattgtttgtgatttagcaaaggatattgatgacttattggctaaaagtgcggtcgaattacgtcaaaatttgtatacaccaaaagttgaattggaacaacataatattttacctgtaccacttaaattagtgcatattaataaatgtcctattcttgctcctgcaaaaacattattgccggaaaatgcaaccaaattgggaattgatcgagaattctgtttgcaaaatttgcaaaaactgcgtcaatctccagatattcgagataaggtcattgaaattttccatgatgaaagagaagtaatacacagtgataatgtagaaactgagttatacaatcagtttttcagtaataatgataaaaacaatatgacgattttgcgtcaattatctccggagaaattaaacgagcataatttatctttttcagataaacgtatcccggatttattatttcattatcgagcaagacatttctataaaacgcttgatcgctctgaacagataaaatggcaaaaatatcgccaacgtaaactggaaaaaagtgcggttcaatttgaggaaagtttacaacgtctagtagaagagtatcaaaataatcctgaaaaattattgttgttacaacaagtatatgaatatggagcaactttacttcgtaagttatattgataatagcaatatctagaaatgcaggatgaaaaggtatttggtaaataaaataaaagagacaacgtaacaactataattttatttactaaaatttatagaggagaagagggttgaatattttaattgattttgatggtacttgtgtaacgcataattttcctgaaataggcgaagatattggtgctgcacaagtattaagagatttggttaagaatggccataacttgattttattcacaatgagatcggaagattgttatcttgatgaggcattgacatggttcaaaaataatgggattgagttatacgctgttaatatcaatcctgaacaatctaagtttaccagttctcctaaagcctatggagatcttattattgatgatattgcattaggcattccgaaatggtcctgccatttttatcgcccttgtgttgattggaaattggtgtcggaaatgctgtatagtcaaaaattgctaacatttgaacaaatcaataaatatgattttagcatgagaaattatttataattatgaaacgttttaaaagcaacgctcacagctatgcgaggacgttgctttttttgtagcttttatttattaagctttttctccttaagaccacactacaaaactattacaaatcatctctctatttaataaagttaaataataatacctttcaatgtacaagggagtctttatctgtcttgcttagctggtataactggcttgtgcataagtctgagatttatttatatcgtagttttcgctaaccgtataactgattactcataatgtatattatgttaaattaaataattagatatgtaacttttggactggtttgcccctctattttgctatgaaatattctgttaattagatgagattaaaaaaataaaaacgataaaaataaaaactagttttttatttttttatatttgatacggtgtcactaaattaaatataattttcataaaaaaagccctatgactttcatcatagggcttaaaattttgaaaactttatttatacacgtttaaaatcaatatggactaattttggcttgaatggatggcgttgcatcgcttgtactttaacagaaatttccttcccttcaataactaggataatagtatccgaatagaaagaatcatgaatttgagcgttatttaattcatcatgatttaatacaattgaaacaggtgcttcactaccaccataaacgatagcagggatttgaccattatgacgcaggcggcggctcgcacccttaccttgcttagaacgaacttcagcgttaaatttaaatgacattttttatgttctcttgaataaaataaaaaaacaaaaaaaccgcaggcgacccagcgatttcccttacgttatgctaaaacttatagtcatgttttagacatggtgctgattataatgagttattctctataaatcaaataaaacattgaatttaaactggatatttctactaaaaaagctaaaatagccgtcatactttcttattataaatgggtagttcatggacttattaattaatttttttactgattatgggtattttgcagttttctttgttctcattatctgtggctttggagttcctattccggaggatattactttggtttcagggggggttattgcaggtttataccctaatgaagttaatgttcatatcatgctgattgtgagtatgcttggtgtgttaattggtgacagtacaatgtattggcttggtcgcatttatggtgtgaaaatattaagaactcgtttaatcaagaaaatagtaacccttaaacgtttaaaaatggtgaaagaaaaatttgctaaatatggcaatagagttttatttgtggcacgttttttacctggtttaagggcaccaatttatatgatatcaggcattactcgtcgtgttagttttattcgttttctcctaattgacttttttgctgcaattatttcagtgcctatttgggtatatttgggtgattttggtgcaagcaatctagactggttacatcaacaaataaagaaaggtcaatttgcaatttatatcttaatacttctactcgcattgttcttattttggaaatggaaacgtagtaagaaaaaagatatgtaatttagaccatcttacagggcgtatttaattatgccctattttatttacggtatagtgattcgtaaaaaataaccatactcttctactttcgatacactagatatcgtataaaatattggggatatataatttaaaaagggtactataaaaagtaccctaatttatctttaaattaaagtgcagattttgctttctcaactaatgctgtaaaagcaactttatcaaacacagcaatatcagccaaaatcttacgatcgatctcaacagatgcttttttcaaaccgttgataaatttgctatacgataaaccgttttgacgagtagccgcattgatacgagcaatccatagttgacggaattgacgtttacgttgacggcggtcacggtaagcatattgaccagctttaattactgcttggaatgcaacacgataaacacgtgaacgtgcaccataataacctttagctgccttaagaactttcttatggcgtgctcttgcaataacaccacgtttaacacgagccattatctaatctcctattgtccatgaatcttaaaaaatttaactaatcgtatgattgtgcccaaaacgctatttatgcgtatggtaagcatgctaccactaaaacttggtctgctttcgcaaccattgatttatgacgtaaatgacgtttacgtttagttgtctttttagtcaaaatgtgacgtaagtgagattgtttacgtttgaaaccacctgaagcagttttcttgaaacgcttagcagcaccacgtaaggttttaattttaggcattgtttataactccgcattgtttaagtttaacatcagataattaggcgaataaaaatacggcaattcataccgcactttactacttgaatttgcactaattatttctttttgggggcaagtaccataatagcttggcgaccttctaatttgccaggtgcagattcaacaacagcaatatcagcaagatcatttttaacacgttctaacatgtctaaaccaatatcttggtgagccatttcacgtccgcgaaaacgaacagtgattttagctttatccccatcctctaaaaagcgaatcaggctgcgtagttttacctgatagtcgccttcgtctgtaccaggacggaatttaatttccttcacttgtacaactttctgctttttcttctgctcttttgcagctttacctttttcataaaggaacttaccgtagttcataatacggcataccggtggttctgcatttggactaatttcaacaaggtctaaatctgcttgctctgccatatttaaagcttgttggatagatacaatacctacttgttcgccatcttggtcaatcaaacgaacttctttcactctaatttcatcattaatacgattagggcgatttgttgccggagctttttttacggttttaataatgttattcctctaacgattttaaactactatcaaactgcaatactgcagaagacataaacgattgctgtatttttagcaaaaaacggcgagattttataagattttcaattactatgcaaggtattaaggcatatattgacaagttttataaataaatgcacttaataaaatacatagaacgcatagaatttgaataagttttttctttgttagcttttctgccggcataactagtttcctttgcactttttaaatttaaaacttcttaattattttatttaatgttatcatttcttgagttagatcaagttttgcattacacgcttttatctcagtttcaatgcttttgaggaatgaatgaaaacttttccctatgaacaaaaaattggacgacgagttcaatctactggttgtgctattcactgtcaagcttgtagtattagtcaactgtgtattccgtttatgtttaatgaacatgaattagatcagcttgataatattattgagcgtaaaaaacctattcaaaaatctcaaattttatttaaagcaggcgatgaactgatttctctctatgctattcgatccggctccattaaaagttatactattggtgaaactggagaagaacaaatcaccgcctttcatttacctggtgatttagtaggatttgatgcgattaatggtatgcgacattttagttttgcacaagctttagaaacatctatggtgtgtgaaattccttttgatattcttgatgatctatcaggaaaaatgccgaaattacgacaacaaataatgcgtttgatgagtcatgaaatcaaaacagatcaagaaatgattttgttattatctaaaatgagtgctgaagaacgtctagcagctttcatccataacctttcaaatcgatactctgctcgtggtttttctgcacgagaatttcgtctaacaatgacccgtagtgatataggtaattatttgggattaactgttgaaacaatcagtcgtttgctgggacgttttcaaaaaaacggtcttttatccgtgcaaggaaaatatattactattaataatatgtcagaactttctacacttgcaggaacgacaaaacctaaaattaaaatgatcggataaaaacttggacgcaataataagttactactttcgatcattttttaaagtacaattacttgtcatttttataaatattgcctattctatttctatagtttgtttccactggaaaaatatgtttattgtttttgcaaaatatcggaggttattatgcaatttaataatatacttgtcgttttaaatcccgaatcagaaaagcaatatgctttggctcgagcagttcgtttggtacaagaacaaaagagcgagaatagagtaagaattacaacttttatgacggtgtatgatttttcttatgaaatgtcaactttgctttcttccaaagaaagagaaacaatgtgtaaaagcattattaagcaacatcagcaagctgttcaaccatatctcgaaaaatatgcggatccgaatattgaatttaattcaattgttctttggcacagtaatgaagcggaagctattacaaatgctgttgcggaacataattatgatcttgtcattaaatatactcaggagaaggaatctttatcggcattaatttttacacctcaagactggcaattactacgcaaatgtcctgcacctattatggtagtacgtgatggaaattggaaacatcaacgtcgaattttggtagcggttaatgtttccaataatcaagaggaatatacttcattaaataatgaacttgtttctttaggaattgatttagcggataaattagaacgaggtaatattcatcttgttaccgcttaccctcccactccaattaatatggcaattgatttacctgaatttacaacaacagaatatggtgatagtgttcgtggacaatatcttttaaatatgaaagcattacgccaacaattttgtatagatgaagagcatactcatgtaagagaaggatttcctgaagatgttattcctgctgtcgcaaaagagctggaggctgaattggttgttttgggaacagtaggaagaacaggactatctgctgcattcttaggaaatacagcagaacatgttattagcaaattagaatgtaacttgttggcaattaaaccgagtaaaaaataacaaaattattacacgaaaatcctaacttaatcgttaggatttttttaaagtaattttaaaaatgagcctacggtatagaatgagccaaatactaaaataatatccttttctgtggcattttgtaccgcactttttactccctcatatacagaagaataagtttgagcagatagctcattagttgttgatatttgttgtaatgtcataaataattcatgactactctgccctcttacgccatctaaggttactaaattccactgatcaacaactttgattaaaggcgataatattccttgactatctttatcttttagaatgccacataccgaaataatttttccgattgatttagctttaagtgcggttaatctttctaataaataggaagctgcatgaggattatgaccaacatcaacaataatttgaggtaattgtttaactgtttttttacttaatttagctaaatttaataatttttctgggttgattttctgaaaacgccctgccagttcaacttctctaagtgatttatgaataactgatatagaaatatcaaaaggtaaataagccaacgttgctaaagctgttgcagcatttgccaagggaatactacaaataggtaaattatccatataaatagctttattaccttttattgtttcccatgtccagccattttcctgtttgctgaatttccaatctttattacgacaaaataatattgaatctaattttttcccttgttctaataaagaacagggaatattgttttcaccaataacggcaggcttatttggacgaaaaatacccgatttttcaaaagcgatctcttctcgagtattacccaagaaatccgtatgatcgatgtcaatactggtaattacggcaagatctgcatcaacaatattagtagcgtccaaacgaccgcctaaccctacttctaagataacaacatccaaattagcttgcttaaagagatacaaagcagaaagtgtactaaattcaaaataagttaaagattgtgatttatgttgctcaataaaagcaaatgcttgagtatgttcttcatcagctaattcttgattttgaattcttactctctcgttataacgaattaaatgaggagaggaataaacaccaacacgaaatcctgagtttagtaataatatttccagtagacgacatgtcgtcccttttccatttgttcctcccacagtaataacaaaaggagcaggctgtaataaatctaattgttgagcaactgtcttgaccctatctaatcctaagtcaattgctttagcatgtgctttttctaaaaaacaaagccactgttcaagtggcgatgttgcaaataaatttaaactagacatcatcagatttttcttgaattaattcaggttcaacaaaaggggatggcatattcatgagcttgcttaaaagattagctaaagtttcacgcatctcagaacgtttaacaatcatatcaatagctccatgctccagtaaaaattcactgcgttgaaaaccctctggtaatttttcacgcacagtctgttcaataacacgaggtccggcaaatccaattaatgctttgggctctgcaatattaatatcacccaacattgcaaaacttgcagacacaccgcctaaagtcggatctgttaatactgaaataaaaggaacacctttttctttcatctttgccaatactgcactggttttagccatttgcattaatgagaacaaagcctcttgcatacgagctccaccacttgccgaaaaacaaactaatggacaatgtaattctattgctttttcagcagcttgcacaaattttgagcctacaacagatcccatagaccctcccataaaactaaaattcaaggcagccacaacaattggcatgccataaagagtggctgaaacagtaatcaacgcatctttttcgcctgtttctttttgggcggctgacagtctgtctttatatttttttaaatctctaaattttaaaatatctttaggttctaaatctgcagcaatttcaacaatgctatctttatccaataaagcaacaaggcgttctcttgcatcaatacgcatatgatgaccgcactttggacaaacttctaaatgacgttttaattcatcacgatacaacacttgctcacaggaagtgcatttggtccataccccttcaggtacatttgattttttgctatttgaagttgtatttttactaaaaattctatcaatccagctcatgtttaaccttttatttattaacttaaaactcgcctcattagaccataagtcgggggaattttccagaatttaacaactccgactagcctattaattcaagcaatttaactgccattaacgctagattaaagtgttgctcatcggctacagaccaaaattctattttattttccgccgcacttaatgtactaatatgcaatttcactttttcctcattgttttcattttctccgtgagtaaccggcgtaattaatttctctgcatgatattgaattagctcattttcttgccaaaaatgtaattggctttctatatcaaccaaataatctgaaagtgcagtcacaaactgccccattccataaaatacaggcacttgaatttgatgaaagacaatattctctaattgtgggtaaattttttgtaactgtataactaaattttgagtttgtacaggaaagacatcaaaggctaaacgttgctgttccgtatccagcggaatcccatttaataattgtgctgtctgtccagccaatttggcaacttgttctgcttctacataggaagcgggtaataatgaagtcacaaccaattgatgaatgctattaacaatattactgatagctaaagcacattgcgttacttgtggatttggaagggaaacaatatttctttggcgtaattcaatcaattgatcgtcattaatacctggtacaacaaccggaatatttgcaaggcttgcacaaatgcccagtacatcgatcacaatacaacctgaatcagctatttttgccaaaagatcaacatgctcaattgtccctgcaaacaaaacataattaaactctgtccaatctgcctcttcaggcataatttgaataactgctttattgttaaaacgaatgccttgctcttctttgaaaggctttatttcaataattgtcaagctttcaatttcaagctgagtgtgttctaaagtttcgacaattttctcagataactcaaattctgctgcaatagcaatacttaacatttttctctcttataaactcggatagaatgcagtgcattttacaaaataattcagggaaaagaaaatgctcctgtaattatttactaggaatattgctcagaaaattaacgcaataaatcccaaacaggacgacaattttccggtaacactagagattttcccaattcaatccaactacttggaaaatgaaaatcggaaccaacggaactgtataaatcgtactcttccgcccaacgagcaagtaataaacgttgatccttggtttgtccacaacctgctacttctattgcatccccaccccactgtttaaaatcagcgataagacgttttatcttttttgttgtcatggtatagcgtaatggatgagcaagcactgcaattccgttggcttgatgaataatctctattgcattagggatatcaacccattgtgttttgacatatgcagattttccttgtgctaagtattttttaaaagcttgactaatgttaataaccttgcctatttgcactaaataacgggcataatgtgctcttgttaattctccattcgtcagtttttgcgtttctgcaaaggcgttggctacacctaaatgctccaattttttaccgatttcaaccgctctttgtaaacgaatttttgcctgctcattcaaaagtgcggtcattttttttgaattttcatcaaaacctaatcctacaatatggatactataattttcccaagaagtagaaatttcaacaccattgatcaatgaaatacctaattgttctgcttgagtacgagcttgcgataatcctgcaatagtatcatgatctgtcaaggctaaaacatttacaccttgttgatgtgcccttatcactatctcttgtggtgataaggtaccgtcagatatagaactatggcaatgcaaatcataaattttgttcatactttcctaaattacttatcaaaaataaaaagtgcgataaatttcaccgcactttcacttagttatgtgtctgttttcgctattgaagggctttttctattttctcaaacaaatctttcgacaaattttccacttcgcttaagcgaactaaagcacgtttcatcaaagtttgccgttgaggatcaaaacgagagaaacgaattagcggttcaattaagcgtgaagcaacttgaggattactttcatttaaccttaacaggatctcagttaaaaaacgataacctgaaccatcgattgcatgaaatccttttaaattatgtacacaaaagctaccgactaaagctcttaaacggttaggattattaaaattaaaacttggatgttccattaattgttgcacatagtccaaagtattgtcttcaggtcttgtagcttgtaaggcaaaccatttatccataaccaaaccgtcttgttgccatttttgctcaaaatccgctaataattggtctcgacaaggtagttgagcctgtgttgccgattttaaagcatttaaactgtcagtcatgttatttgctttgacataatgtttattcaccaaattgttacctaaatctgtataagccaaataattcaaacagagattacgtaatgctctcaacgcaatatcttgctcagttacttgatatgtctctaactgaatttcattataaattttcaagaataactctttcaaattatttgcaatatggcgttgcataaattctcgcactgcataaataccgtccggatcgatcgttttgaataattcggcaaattcagtttcttttggcagtgttaaaatcgttgttactaaaccaatatcttgctggtaattttctaatacttgataaagtgcggtaagaatttcagcagaaaactccagtgccagtccttgttgataatgaattaagttacgtcgtaactctgcattaaataacatttgagccgcatcccaacggataaaatcatttccagcaaatttcaacagtatgattaattgttgtgtattgtaagcataatctaattttaccggtgcggaaaaatcacacaataacgctggtacaggacgtgtataaatgttttgaaattcaaaaacttgttctttttgtgtaagatttaatacatcagaaagatctttgccatcagcctgtaaaaattgctccacaccgctttcatcgtataaagcgatttttattggaatatgtaaattgactttttccatctgatcggcagttggcggggtaaattgtgagattttgagttgataaacgtgatttttttcgtcataaaaatctgttacaaccaattccggcgtacctgattgactataccaacgacggaattgggttagatcaagtttattggcttgttccattgcaaggataaaatcttcacaggtcgccgccttgccatcatggtctgcaatataacgttgcatacctgcctgaaaacctttttctcctaataaagtatgaagcatacggatcacttctgcacctttttcatatactgtaactgtatagaaattattcatttcaatcactttttccggacgaattggatgtgacatcgggcttgcatcttctgcaaattgtactgtacgtaaaaattttacattattaatgcgattgattgctcgtgaaccggtatctgatgagaactcttgatcacgaaatacagtcagcccctctttcaaacttaattggaaccaatctcgacaagttactctatttcctgtccagttgtggaaatattcatgtgcaattacactttcaatcgctaaataatcttcatccgtggcagtttgcggattagccaaaacaaatttagaattaaagatatttaatcctttattctccatggctcccatattgaagaaatcaaccgctacaatcatataaatatctaaatcgtattctaaattgaaacgtgcttcatcccacttcatggactttttcaatgcactcattgcccaatgagcacggtcaaggttaccccgatcaacatataattccagtgcgacattacgaccgctctttgttacaaaattatcctgtaataagtcaaaatcacctgcaactaaagcgaataagtaacttggtttagggaaaggatcttgccattcaacccagtgacgaccatctttcatttcaccacaagcaatacggttaccgttcgataaaagataaggatatttcgttttatccgctgtaatttttgtggtatagcgagcaagtacatcgggacgatccaacatataagtgatttgacggaacccttccgcttcacattgcgtacaaataccctcaccggattgataaagcccttgcaaagatgtatttgcactagggtttagatgagtaacaatttctaattcaaaggtatcggcatttacgttggttaaatccaacacgaggctttcagcatcttgttgataagatttaaactcttcatcattgagtttgactgaaacaaattgaaaactatgaccatcaagacgtaactgtttgctttcaggattaagacgttgaaattgacttattgctgttacgatggtttgttgcggatcaagttgaaaatcaagataaatatcagtaacagtaaaatcgggggattgataattctttctatatttggcttttttttgcataatgacaacctaaatttattgagaaaaactgtgctaggatatgatttttcgctaggtatttcaagttataacaattaagggagcgtttcgctcccttttgaagttttgttacgctaattttaatggctcaattttccatattttttctgcatattctaaaatagtgcggtcagatgagaagaaactcatattcacaatattttgcaatgcactttcaacccaagcttcttgatttttatatttttcatccactgctttttgcatctcaacatagctacgaaaatctgcaaaagattgataataatcgtaagaacgcaatgaatttaacaaatcatgatagcgagtaggttctttgggtgagaaacgacctgcattaatctgatcaataacttcacgtaattgttcatccgactgataaatatcaaatggatgataaccattacgccgtaactcttctacttgctctacggtattaccaaaaatgaagatattatcttttccaacattttccaatatctccacatttgcaccatctaatgtccctagcgttaacgcaccatttaaagcaaatttcatattgcttgtaccagaggcttctgttccggcaagcgaaatttgttctgaaatatcagccgccggaataataatttgggcaagactgacactataatttggaataaacacaacttttaaacgaccttgtaagcgatcatcattattaatgatatttgccacatcattaattaggttgatagtttgttttgctgccgtataagctgaagctgctttaccggctaaaataaagacccgaggtgtccaatctttttctggattagcaatcatttcattgtaacgagcaacaatatgtaacacattaagaatttgacgtttgtactcatggatacgttttacttgaacatcaaatagagcgtttgaatttaattcaatacctaactcttgttttacataattcgctaaacgttgtttatttttacgtttaatctctggaattgcttttttcaattcaggatcttgaatatgtgctttaagcgtttctaattgagttaaatctttacgccattcagtgcctatatatttatcaaataatgcggataaatcaggattcgctaccgcaatccaacgacgaggggtgattccgttagtgacattggtgaaacgttcaggataaatgcgataaaaatctgcaaatgtagaacttaccattaaatccgaatgaattgctgccacaccatttactttatgcgatccaacaacagatagccaccccattctcactttacgtatattaccttcctcaatcaatgatatacgacgaataaagtcgttatcagtagtaacagaagtgcggacatattctaagaaataatcgttgatttcaaagataatctgtaaatgacgaggtaatatcttcgccatcatttctaccggccaagtttctagtgcttcagacattaatgtatgacaagtataagagaatatctgacagcacatatcccaagctttttgccaagtatatccttcttgatcaattaaaatatacatcaactctggaatagctaaagcaggatgagtgtcgtttaaatgaattgcaattttatccgctaaattatccaatgtattataaattcgcttatggcgtttaataatatcttgtagagaagctgaaactaaaaaatactcttggcgtaaacgtaattctctgcctgcagctgttgaatcatccggataaagtactcgagaaacattctcactagaagatttttcttcgatagcatggaaataatcaccacgattgaatgacactaaattaaaagtttcacctgcgtttgcactccataaacgtagtgtagctgcactgtcattgctatatcccggaatcatttgatcgtaagcaagtgcggtgatttcttctgcatttttccaaatacattttttcccttcaaaataaatatgccctccaaaacggatattaaagcgtttagacggacgaataaattcccaaggataacctttttctaaccacgcatcaggtttttcaacttgtttgccatcttcaatatattgctgaaacataccatattcataacgaataccatatcccataccgggtattgcaagcgttgcgatagagtccataaaacaagctgctagacgacctaatccaccattaccaagaccgggatcaacttctttctccaatacatcttctaaatcgacattaagttcagctaaagcatctttagctaagtgatatacgccttcagaaattaaggcattagataaagtacgccccatgagaaattccattgaaagataataaactcgccgagtttcttcttttcttgcttgacgggcagtggaaatccagccctctgttactaaatcacgtatggcgtataaagttgcatttagccaatcacgttgacttgcctcctccggagaacgagcaattaaaaaaattaatttatatacaatcgatttcttcaacgaatccttcgtattttccggacgattataagaaaaaggaaggggaagtgtatttaccattaggctcaaactcctgatttaataaaaaactaccgaattttattcatctgtataaaaaaaacaataaaattttataaaaaataatttgaatatttctactcaaattatttcgctaaaaaatttatttatgtaaaagaatatcatatagggattgatatccttttgcagatgtctgccaactgaaatcctgttccatagcattgactatcacactttcccattgacttggtttacgccacaaagtaaatgcactatcaataccataacataatcccccaacatcagcatcattaaatacaaatcctgttgcatgacgtgctttgatgttttcactgctactatcaatgacagtatcagccaaaccgcctgttgaacgaactaacggtaaagttccatattttaatccgtataactgcgttaagccacaaggctcgaaacgacttggaacaagaatgacatctcctccggcaatcattaaatgtgataatgcttcatcatatccaatttttactgcgatattttccggatactcttgtgcaagccaattaataccggcttctaaatgtgctgaaccggaacctaaaattgctaattgcccaccttgttgtacaattctctcggcactaccaattagtaaatctacacctttttgctctgttagacgtgtaaccattacaaataacagtgcattaggattttgtggtaaattaaaataagcttgtaattttattttattcttacgtttaccctgcattgatttcaatttgtaatgatcttcaatatacggatcactatacggatgccaaattttttcatctacgccattcaaaataccaaccaatcgtccctgtgctttcaaagtttgcaacaacccttgtaaaccataagcaaattcaggtgttgtaatttctttggcataggttggactaactgcagtagaaatatcggaataatacagtccggcttttaaataagacatttcaccatataattccaatccatctacattaaacatccaccaaggcaatccaatttcagttagatgataaggtaaaaaacgtccttgataggctaaattatggatagtaaacaccgatttagcagggcgtcctttatgatgcaaataagcagctgttaagcctgcatgccaatcatgagcatgcacaatttcagcacgccaccaaaagtctaatcctgtagccaactctgccccaacccaagccaataaagcaaaacgcttatagttgtccgtataatcgttataccacatatcatggtatggattaccttcacgggcatataaatgcggtgcatcgattaaataaacaccaataccattgtattcaccataacgtagtacaacatgtccggcaaaattatcaaattcagcaactacaacggtatttggaataccacgagaaatagcaggataagccggtaaaacaagtctagcatcaataccaatttcattttgtgcaaaaggtaaagcccccattacatcagccaatccgcctgtttttaataatggatataattcggaacaaacatgtaatactttcattgttaattttaatcctcccatcaaggcggtaaaaataaaaaattctaccgcacttatttatatttacacctagtctaaatgaatttcagagacaactttttcgccatttaattttttcatcattgattcagttaccaaaataacttttccggtactacttacacggaagcgtttgcgatcctcttcaatatttacaccaataactgtgttatccgggataactacttggcgatcaataatacaattacgtaaaatacaatttttaccgatagttacttgaggcaacaccactgaatattctactttagaatcagctttcactttcacttgatcaaataacacagaataactaatttctgcatcagtaatcacacaaccaccggaaataagcgaattatctaccggtttaatatcttgcttgttatagaagaattttgatggataagtttgggtcggattaccgcgaattggccagcgttggtcataaatatccaattgcggatgttcagatactaaatcaatatttgattgccaaaaactatctaacgtccccacatcacgccaataaatctccccatccgtattacgtcccatacaagatcggctaaacggatgtgcatataaaacttcttcctctaaagattttggcagaatatctttaccaaagtcatgagaggtatacggtgtatttacttcacgcatcaatacatcatatagataatctgcatcaaacacataaattcccattgaagctaaagaagtatccggtttatttggaatcgccggtggatcttttggcttctcaacaaatgcttttactttcaaattttcatccactgccatcacaccaaactctgatgcttgttcacgtggaacttcaatacagcctacagtacattttgcattgcttgaaacatgatctaagagcatttggctataatcttgtttataaatatgatcaccggctaaaattaaaatatattttggacggtaatgatcacgaataattgccatattttgataaaccgcatcagctgtgccacgataccaagtagaatcatcaatttgctgacgtgccggtaacatatcaataaattcaccacgttcttgcggtagaaatgaccaccctttttgtaaatggcgtaataaagaatgagcagcatattgcgtgactaccccaatgcgatttaagccggagttaatacaatttgataaagcaaaatcaataatacgacggttgccaccaaaatataaagctggtttagcacgtttatctgttaattcatgaagtcgtgagcctcgacctccggcgagaattaatactaaggtatctttaacaagtttatgtttacttaaatttttagtaatactgttactcatagcaactccttatcttttatttttatactcacgactaactcacatttacttgagttattcactttttctgcaacacaccaaaagccaaatccgtcatctccaactgcttgttttctaaatgtactacttttgaataacacaaaatctcccaattgccttgaggtaataagaatttttgtgaacttgtttttgcgttgataacgaacaggtatttactgtccagcaaaatctgcagagctttgctctctttattatgccactcatctaatgacatcttctcagcatcaatatttaaccaagatacattgctctcctgccaccaattatcccgttgtaaactcggaatttgtttacgcaatgcaataacttgcttaaccaaattaaagagatcttgttcaaaatattgccattttaaccatgttgtttcattatcttggcaataggcattgttattaccatactgcgtattaccaaactcatcaccagccaatagcattggcgttccgtttgataataacaagctcagtaacaacgcactacgacttaaataacgagcttcttcaacaagagaatttccctctttatatccttccataccatggttataactataattctcactccgcccatctcgattatcttcaccatttgcccaattatgcttttggttataacttactaaatcatgtaatgtaaaaccatcatgtgcggtaataaaattgacagaattatgtggtaatttcccctgacaacgatatatatcactcgaacctgcgaaacgctctgcaaaaacaccgagttcaccgcttttccataaccaaaaacgacacatatcatcacgaaatcggtcattccattcagcaaaatacgctgggaaattacctacttggtatccacccatacctatatcccaaggttcggcaataaatttaactttttgcaaaattgagacctgctcaatttctttaaataataaggcattagcattaaaatccggcgtttctcgtcctaaaactgaggctaaatcaaaacgaaaaccatcaacatgacattcttctacccaatagcataaacaatcaattatccactttcgtcctagttcaatggataaattaagtgtatttccacaacctgttagattaatgtagtttcccgcttcgtcctgccaataataagtccgatcatcaattcctcgttgactaaacgttggaaaatacttttccgattcaacagaatggttgaacactacatctaaaatcacctcaattcccgctttatgtaatgcttttaccattgatttaaactctgttaagggtgttgtatcggcttgatttgaccaatatttggactcaacagcaaacatcgctaagggactataaccccaataattctgtagtcttttctcctgcaagtgcggttcatctaaatgataatttattggcaataattccaccgcacttacacctaattctttcaaataggcaatgacattttgatgagctaaacctgcataagtccctcgaattgcttccggaatgtcctctcgcaactgagtaaaaccttttacatgcaattcataaatgatactttctgaccaaggtgtttggggtaaaatatcttcttcccaatcaaaagatgacgattcaattaacgctttaggtgctaaatgtgcattatctctctcatcttcaagtaaaaaccaagctctattttctacacaacttaaatcaggtttacccacaacagctttcgcatagggatctaacatcaatttatttggattggataaagaaccatccacgccatgaatacgaaaaccatattcagttccatattccaattcagttacccaaatatgccatatattttctgtacaatacattgaataacaggtttcttgaacagaatttttattaaaaatacaaagttcaaccgcacttgcctgtgaggaatagattgcaaaattaaatcctgcaataccttccatacaacattctgtacaacctaaaggatatggtttacctaaactcatcttgctcataaatattcaaattgtttttatacctttagctaacgttgttttctactgatgtcgattctgcaatcacctctgcatttggaaaaacagcactttcctcgttttttacttttttaactaccgctctttttgttaccgtctttttaggcttaacctctgttgcctcagagacagtatcagcgacagtttttttggttctcgtggttttaccctttgctatttttttctctgttttcaccgctgtatcttcaactttcgaggtttttctcatttttctgactttttttactttatgcagtttaagatacactgttgctagaggagggatatcaatactgatagattgtgctttattatgactttcaatatcttcagttacaattttgctcgtatttgtcgaatttgatcccatatactgttgtgcatcggagtttaaaatttccagatattcaccggcaatatttacaccaaaacggtaattttgacgtaaaacaggggtgaaattactgacaacaataatacgttcatcttttttactacgacgctcaaaaacaaacacggaattttgataatcatcaacaacaagccattcaaaaccttgtggatccgtatctaactcaaagagcggtgcatttttttgataaatatgattaagatctctaacataatcctgtatagctttatgccagccaccaccatgaaattcatcaagaagataccaatccaaactttcctgataattccattctctgccttgagcaaattcattgcccataaagagtaattttttacccggataaccccacatataaccataatatgcacgtaaattagcaaatttttgccacgcatctccgggcattttaccgagtaatgaacatttaccatgtacaacttcatcatgtgaaagcggtaaaataaagttctcactatattgatacaccataccaaaggtcatttggctatggtgatgttgacgataaatcggatcttttttcatatacgacaatgtatcgttcatccaacccatattccatttaaaatgaaaacctaaaccaccttcatacggaggatgagtaacaccggcaaaagaggttgattcttccgcaattgatacaacaccaggaatttccgttcccaataaatgattagtttgtttcaaaaattcaatggcctccaaattttcacgaccaccatactgatttggtatccattgcccgtcttcacggctatagtcacgataaatcatagacgcaaccgcatctactcgaataccgtctaagccaaatcgctccatccaatacaacgcattcgaagccaaataattttttacttcatgacgaccgtagttataaatcaaagtattccaatcttgatgataaccttctttgggatccgcatgttcatataaagccgtaccgtcaaaagcaactaaaccgtgcgtatcgcttgggaaatgacccggaacccagtctaaaatcacattgattccagccttatgagctttattcactaaacgtttaaaaccttcggctgtaccaaaacggctagtcggagaatacaaacctataggttgataaccccacgaaccgtcaaatggaaattcagacaggggtaaaagttcaatatgcgtaaatcccatgtcttttacataaggaataagctcctcagcaatttgatcataatccagccaaaaattattttccaagttacgacgccaagaacccaaatgtacttcataaattgaaatcggctgatcagcttgattagcttttcggcgtttttcagtcattgatacaatttcaggcaatgccccaatttgtgatgctgtatcaggacgtaattgtgaactgaaggcataaggatcggcttttaagcgtaattgattatgacagtctaacagctcaaatttatacagttgccccaacgatactttgggtaaaaataattcccaaataccgctagattgatgaaaacgcattgggtgccggcgaccgtcccaatagttaaaatcgcctacgaccgaaacacgtttagcgtttggtgcccacagacgaaaatttacacctgctacgttgtcacattcggtaaaatgtgcacctaaaatttcataagggcgtttatgggagccttctgccagtagccaattatcaagttcattaatcatcggatgaaatgcgtaaggatcttctataacttgagcttcatttccccaataaacttctaattgatacgcaaaaaaactatgcgtattaggcacaacaccggcaaaaaaaccacgttcatctaccctcaataattcacaaagtacattttttgtttctttactgagaacaaatactttttcagcatccggtaataatacccttacttcaatcccatttgacgtttcatgcatacctaacacggaaaaaggatccgcatgttctccatcaaaaaaagtatcaatggtagattgtgatacaaatttattcataaaaaccctgcctatttatttcttgcctgattaattgttctaattaatgaaagtactgttttatcagtaaaaattttttctagcggttgtaataatttcttacgccagttaggatattccgttgaagtaccgggtaagttaaaagaaacctcttgattaagtaaattttccagttgtatgccaattaattgcgtttgactttcagctaaatattgatgaatgacatgatttaaattatcgtgcattgccatatttaacgcatctccccaataatcaggcggtaagtattgatctcggtgcaaagtattaagcaacgcttgtttatctactactcgctgatcatattttgattttaaaacatcttctttcaacatacctaattgagcaaacagttctaaatcacgacagtgccaaaaactctgcaatgaaggaagatcatgagttccaactgtagcaaatgcttgcaaaggaaaatgatctgctttcggatattcgttgtgttgttgctcaaaatacagaacaaaataagagaacactttaaattcatccaatttaaaccgcacttcattaggtacagtacctaaatcctcaccgacaattaaacattgattacgctgactttcaattgccaaaattgccatcaactctgcaaaaggataatgtacataaagtccatcacaggcactttttccttccggtattaaccacaaacgaaacaatcccataatatgatcaatacgtaacacaccaaaatgctgcatattggctcgcaacatatcaataaaaggctgaaagccacgagcttttaaaattattggattataaggcggaatattccaattttgtcctaccggacccaaaggatccggcggagcaccaactgaagcgttcacacaataaagtgtttgatcggaccaaacatccgcacttcctctcgaactgcttacagccaagtctccataaattcccaacgatagacctttttccaagcacaagttttttacttcagttaattggatagtagccaaccactgcacccaagcgtaaaaatccacttgtgttttatatttacgtaacaaatttttgcgttctttatcagttaaaatttgccattctttacgccaacctaaccaaccaattttattttcatcttccggcatattttgatgttcaatactatctaatacgtcaaataaagcctgagataataaagcatcaccttgtgccttcacaaactcagcaaattggcgacgacgctcaataattttacttgctctgctacgcttaaaataagcgaataactcttctaatgcagaacgttttaatgacattactgcctgataatctacgatatcagattggcacaactcagccagtttagcttgagtattctcttgtttaaaccaattttggactttttgacacaaattaaattcaggtaatttatctactgccaaatataaaaaattcaaccaacgtcttgaagaagaactgtacggacttgcccattcaggaatagccggataaagttgatgtaacggattaattccaataaagtcagctcccagcaccgcacttttctcaattaaatatgcaagatcggcaaaatcgccaatcccccaattgcgtgcggaaaccaaactataaagctgaacattaattccccatgcttttttacgttgaaatactgtcggttgataagattgttgaggcgaaactaaaatgcgaacgacatagttatttccatttatttcaagaagcaacgaataataaccataagctaaaggagataatgttagttttttctgctctttaagaagttggctccgagacaggaagttcccattatcatcatacaaagaatattgaatagaaatgccggaagataaattaaatgcggttaagtcataaattataggttcattttcactgacgactattacatcatcaaattttttatcttctgaaccgacttccgtttgattcagtaattgaatgaaataatgcagactttccggttttgcgtaaatcaaattaccatcaatatcataatgagatatggcaatccctattttttctgcatcttgttgtaattgattagaaatgcccatcttactctcaaaaagcttaaaaagaattaaatcaatttcattctatctaatcttaactgacaaaagcaaacgcattactttaaattgtgatccagttcaaatagaaattttaagttttttcatcaatcacaaattcaaaccaatcaatcacatctttttcatgaataccctgctcaatcatcacaccagcacgtttcattgcttgagaatgaccaacgatgagaggatgccaatcaaagagcggtttattttcataaagtaaacgataagcacaagtactgggcaaccaactgaaatgtggcaaatttgctttagttaattttgtacaatctttctctaagcgaaaacgtttctcataatgaccgcactttcccgtttctaaattcaatagattgcaagcaatacgagtaaaatacagcttttgtcgttttcctcgcccttcaataaacttacggtaacagcacttgccacaaccatcacaaagtgcttcccattcttcatcgttcatttcaagcaaagatttatatttccagaattcaggggataaagtcatttcgaaaaaaaccgatactatcatcttaaaaaaataatccggttaaatattattcaaccggactcgtagaatattacccaattcagggagtacggaatttaaccgcacttttattactgtgtcaatattgcttcaaatctaaattgagatggcaaaattttatgggctaaagcctctatattttgttgagttacttgctgtaataactgttgctcagcaaacataagcaaaggaccatcactcaaagaataactttgttccaattgagataaaatggctaacaatgattccttcgcctgttttaactgagattgtttttcactcacttttttagccaacaattcaggctcaatgccttgtttaagtatttgatctaatacatgatgagtcatctgcgttaattcctgtacacgcataggatcacaactaaactctattttcccctcaatttgaggtgaaaaatgttcttgttcaaaccacgcatgcactgcatagatacccgatgcctgttctcttaaactcaaccgtaatttctcttgtatgatatctgctaaaatatccagtaaatatttgttttccacttgccattgatgatcagctgcgaaatacatttcaacttctgctcttggctcatgcaaccctttaacaactaaacgctgctcgggtacatgtgcctttatcggctgtaatactctattttgtgttttaaccggtacattggctaaatatttttcagccaaattttgtaccgcactttcgctaatatcaccaacaataaaataagtgaaatctgttttattcgtaatatattgctgataaattgcggaaagtttatctgccgttaaatgcagattactgaaacgatttgcaccatatagcgtttcttgttgtggaaaacgcaattgctctactttctgcataaacgtcttttccggacttttttcattcacttcatcctgtaaagtttggcgatattcggctaagactttctctgaaacagggctggtttgtagttttaacctaaataatcgcagaatatccgctaaactttctgttttacctgccgccgtaaaaccctgatcagcctcatcaataaccgtcgtaaaagctatcggagcgtgactgaaatactgatcaatatcagcctgaggtacaatgccaattccagtatcatcgaccacagaaatcgccgctcttaacgcatgataatgtgatcttggcacagaacgtaatcctcctgctgtcaaggctttaaaataaacttgttgcggacttttatcactatacatataaatcaatttactgccgttacttaacaaatattcagtaattttttgtccacgccatactttttgcttagtggcattgcccgcaactaaatctaaatgcggaagctgaactaccctattatcttgttgttgccaagaagattgcgattgctgtaaagcctgttgccatttttgtgccaaccattgactatcaaacgataatttgtgcggttttggctgagtaatcagcaccaacttggactttaactgcaacatttgttgaaaagtgcggttaatatctgccaaagtcagttgattgaacaattgatgatttaattcatattgatcttgcggagagagtagcacttgatcatttgccatggtaacaactaattcatcagcaattttgatactactcacttccaaatgtcgttgtttagtatttattttacgcaaacgctgaagttcatcatccaattccgtctgcgtaaacccgttttgagcaatttccgcaataaagttaaagagttgctctgtcgctttttgataatcctcattctcaagttgtaaagaaaatgtggattgtaacgtttgcttacctaaataatcatgataaaaattagcagattttacgaccgcacttgaagactgatgtaaatatgtttcccattgttgcaaacgtaaattaagcaaacgcaccacaatttgttgccataaattctctcggtattgtgctaccgtattgatattttccggcggtttaaaaaaactcaagtccaatcccggttcacgcatttctttctcagacacggtcgctaaacgccatttaggcggtaaaggaatatcaaaatcaatctcgggtaaaggttggtgttgtagcggatggctactccctaatttctgttgaattaaagacttaatttttaccggattcacatcacctaccacaataagactgacattatccggacgataccattttcgataaaaatcttttacacgctgtgccgaaacatgtttaatgacgttgacatcaccaatcggatctcgttctacataacgtgaccccgccatttctatttggctttttttatcccctaaacgcaacataggacttaaacgtgaacgccattcttccaacacaattccacgttccgcctctaaatccgctggtaaaatggtaagatggtttagccattgatcaataacattgaatgccaagctaagagattgcggatcatttttagcgatatttaatgtataaaccgtattttcaaaatcggtaaacgcattaatatcacgtgcaaacttcattcctaatttctcaagtgcattaataatttgattttgcggatattgttgcgagccattaaatgccatatgttcaacaatatgggcaacccctttttgatcatcctcttcgtgcattgaaccggcattaactaccaaacgcatatacacacgattttgcggaaaatgattaggtaaaatgacataacgcaagccattttccagttgtccttggtgggcttgcgaatgaaaaggtaacgtatctttttcatgaaataaggattggcaagcaccaatccccaaaagagcggttaaaattagcaatattttttttaacattagaattcataccctaattcaagccaaaattcacgacctgctgcgtagaaaccattatcctcgttagaacttaacccctttctcgtttgattaaggacattcaatatatcaaatttcacaatcgcagaatgtttaccaaagattttaggttgccaacgaaggctggtatcccattgtgtatgagtgccgtaattgtaactgcgataaatcggtaactgactacttctactacctgtatccaattgtttaaacccttttataggtgcttttacataaattcggttggtccattccaaattataatttggcatagacatatccacgccaatccgagccatccattcttcacgattgttattaactttagaccgcatttctaattcggtcatttgttttccgtctaaaatcacaatggaattcgggtcatatcctacacctatatcaatacctttggtatttaaccaatcaaaccctagcgaagctcgccattctgtctgccaaaatttccaactgtctttattttgaatttgcaacgtatatacattattgctgtaatctttgcctcgtgcaaaatgacgcacttttttaccattttgaccatcttcttttagtatgatgcggtttttattttgacgatgaatatatcgggcatcaaggataacattcccgagttcttgattaatactgaaactcaattcatcactaaacggcgttttcatggaagcaacggactgataacgtgtggttcctttagtgccatcaatatcatctaatttgaaaattccctcacttaatttcatggaagcaaaagagcggccataataacggtttgctccgaggcttaatttggtttgttcaaagggttgatagcgggcgacaaaacgaggggcaatattggtatttttcaggaaagtatcacgctctaaacgtaatcccggacgaacttcccatttaccccccagcttgattaaatcttcgacataaagggcgatattgtgataatcggtttttactgttcctttggaaacggaatttgaagaaagaggactttccatactatcctgcatgaaaatttcagatttagcattttgatcacgttgaaaacgatagtgcgtaaattgccagataccccctaaggaaatagaatgttcagtacgtccccaagtcaacggatccatagcaaattcactggaaaaatgcacattgcgttgcgttaaagcactatctcccattcctccacgttcataattaatcggatcatagttttcatcaaatgccaatatttgcttcaaataattagaggcggatttacgcttatctgcaaattgatcatacgccaatgtattagttaacacaccgctctttaacgaacgaatccaagctaaagtggcaccataggcttgatgataatcttgcacattgctatcaacatttgtatcaaagaatttagtttccacataattagaataacgcaaactcaattcaaagcgattatcctcattagcaagccagttaaaattcaacaacgcattatcggaacggcgtttatgtctgcgattatccgaactcaacttgtcatcttttcccagcactaaacgacgttgctgaatatctgaagtacggcgactaaatcctgctaccataccgatatttttccctaaagaatgttgtgcagaaaggctgaagaaatctttgctatatttaggttgaaaatccgcactactaccgttaggcgaggcttgtttaaatttttcccgatctttttcctcaagatgaaacttcgcccaattagaatggctggtacgataacgcagttgcacaccatcggtaccatcgtattgcttggttttggcgactacggcaccgccggcaaaaccgcctaaactggcggaaatatcgctgtcgtaaacggttacggaagacaataaattcgcatcaaagaaataggcttgtgcatgacttgccataggcaaagtttgcatcgctccatcaaaaatagccgagtcaaagcctaaatcattattgatattgacattatctacaaaataactggtttgattggcttccgcaccattaatcgaaatgtcagcaggtttaatttcacctcgttgaaaactgttttcatcactacgttcaaaacgcacatgagaattggttttcaaaaaatcagaaatattgccgttggaattaggggaagatttaatatctttggcggttactttttggctggaagataatcctgcgttttgctctgcataaacaacaacctccggtaattgattagctcgttcaactttatttttacttgtttctgcttgagcggaaaacgctaaacagacgctgacagctaataaggtttttttagtttttaaatcataagctgacataacttttccttaattagatataaatgataataattcttataaattttatcatctaaattttttaatgtaaaaatgttcatcgcttgcagaaaaaaaataatccgaccataggtatgatcggattatgtgagaggcattaaaatcattaaatatactcagtaatacaaccgcacttttggcgaaaaggaacagatattaaaacccttctttcagactgacagttagattaaaaactaagttatctgcattactgtctttgctatcggcacaataatacccttcccgttcaaattgatacgcttgttcagctttggcactagcaaggctttgttcaactactccatgcttaatgattaaggaatttggatttaacacttcattaatgtcttccactgctcccggattcgctacagtaaacaatttgtcatacaaacgaaattctgccgataaattatccgttgctgacacccattgaataacaccttttactttgcgtccctcaggatttttacctaatgtttcgggatcataagtacaatatactgtggttacacaaccttccgcatctttttcaacacgttccgctttaatcacataagcattacgcaaccgcacttctttacccaacaccagacgcttatattgtttattcgcttcttcacggaaatcagcctgatcaatataaatttctttggtaaaagggagttccctcgttcccaattcttcacgatttgggtgattaggtgcggtaagtatttctttcccatcaaaattttcaatcacaatttttagtgggtttaacactgccattgcacgaggtgcgtttgtgtttaaatcatcacgaatacagctttctaatgcactgtattccaccacgttatcctgtttagttacccctatacgacgacaaaactcacgcaatgatgcaggggtataacctcgacgacgtaaaccggaaatagtaggcatacgcggatcattccaaccgtcaacaatcccatcattaaccaatttcagtagcttacgtttagatgtcaatgtgtattctaaattcaaacgtgaaaattcatattgatgcggtaatggacgctcaatcgaaatattatccaatacccaatcatatagacggcggttatcttgaaattctagcgtacataatgaatgagtaattctttcaatggcatcggaaatgcaatgggtaaaatcgtacatcgggtaaatgcaccatttatcgcctgtttgatgatgacttgcaaatttgatgcgatataacacaggatcacgcataaccataaaaggagatgccatatcaattttcgctcttaaacttgccgcgccttctgcaaactcgccttttttcattttttcaaataacgccaagttttcttctatgctgcgatcacgataaggactgtttttacctgctgatgtaagtgttcctctatactcacgaatttgctcgggggaaagttcatcaacataagccaacccttttttaattaattcaattgcataactatacagttgatcgaaatagtcggaagcatagcgaggctccccctcccattcaaaacctaaccattttacatcttgcttaatactgtcaacgtattccacatcttcttttaccggattggtatcgtcaaaacgtaaattacatttaccctgataatcttgtgcaataccgaaatttaaacaaatcgacttagcatggccaatatgtaaatagccgttcggctcaggtggaaaacgagtataaacattatgatgttttccactagctaaatcttcatcaataatttggcgaataaaatttgttggtttatgttccgtattttccatttcaactgttatttcgctcattttttgtcctcaatgcaatttgataattaaaaatctgcgtattttacagtgttttgcacagaatacaaagtacagcggattttatctcacttggcatatctgtacattaccttttgtaaactttcaggtaaaatagcataacctctaatacaggtatttttataccgcacttatttttcatgaaaaggaacgtttatgtctgatttgaccctacacagccgacatacctatttagatcaagtcaaacacattgtggcaatcggtgggggtcatgggttaggacgtgtcatgtctgcattgagctttatgaatgagcgtcttaccggtattgttactacaacagataatggcggctcaacagggcggattcgacaaactcagggcggcattgcttggggtgatttacgcaattgccttaatcagatcattgcagaacctagtacagcatctgctttatttgaatatcgtttttccggtcaaggtgaattagcagggcataatttaggtaatttaatgctgaaagcactggaaaatatgaatatccgtccaacagatgcggttaatttaattcgagatcttctcaaagtgcggtcttttattgtgccaatgtctgaaagccctgtacaccttgccgcctccttgtctcccggtaaaagtatcgttggagaagtaagtattgatcaattaaccgaaatccctacatctatttttttagttccattagtacaggctaccactgaagcaattcaagctttaaaacaagcggaagtcattttattcggtccgggtagcttcttaaccagcattatgccgccattattactaccagaaattattgaggtactgaaaaatagtcaagctaagaaaatctttattgataatttaggtgtagaacacggtcctgccgccaaattatctttaatcgatcgcattcaatggattaatcaaactattggttgtgatattattgatggtgcgatcgttcaaagcaagccgcaacagaattatcacgcctcctcaataaaaatcatggctcgccaacttaaagccgatgatataggctaccgccacgaccgcactttactttgtaatgcgattgacgaattattgacagaattagctcatcatttttcacctaagcaagtttgactaatttagctggaattccttgtctaacagcggagccacatacccaatcaacccaaggcgaggcaatctctttggtactatctaacaaaccaagatcattaatattaactccggaaccaatctgagcatgtccttcaattaatttcccattaattgtataacctgtagcccccagttgtttatgtccataaccatgctcaatcgcaattgtccctttaatgacaccgttcatcacaaccagctgcacaacagcttttcctcccggggtatttagctccacaagctcaccatgatgtaatccatattccgtagcatcctgttgattaattgccacaataccattaggtttaatactatgtaatcttagcaaaggtgctgtaatactactcattaaatttgatttaaaggaaattaatttaaatggccattgtattttagggtaatggctttcaactgtgctattatcggcaaactgatcttcaaaatacgttggacagccgtgataatttttaccggtttgagcatgtttggcttttgctacattttcattccaaatttgcaaacagtttttccagcgagcctgcatattatcttcctgccatgcactgctatgaggagcaaaacgtccgcctttacagtaaattgtagccactttcttaatttcttcaggttttaacacttgttgtaaacttggcatcaaacgttgtacacccgttagcaataaatcttcttgagttgcatcttgtaccggctgttttccatcataagctatattggcagctgctcgtaaaaagaaatcttcactacgatttaaaggataggaatgattttgtttatctaagatagcattatcaccaaatccaggtaattgcatcatcttagcaatttcgataacaaaactttccatacaaatagtatcgccttgagatgttttctcattaggcgatgctatcacaggccagcgggcagtactggtttttgttggaacaccagcccaaggggtactaaatccccaactctcaaaattatgggtatccggcacaatataatcggcaagggcggtagtttcattcataaaagcatcaatagaaataaagagcggtaagattttcggatcttttaatttctgttgcgtaatatggtgaatacctgtcataccataaattggattccccatatgattaatccaagctttaagtgagtatggatagccttgtaaggcagaagtaatcatttctgacatttgtccgccaacaaaaggataccaagcggctttcgctggatatggagaaataccttgtgctactttttgtttaaattcactggatttttcataatcttttttactacgcgctaaatttgttcctttgggtttaaccatattggggaaatttgcaagattgtaacgagatccagcagcaaaatctttaaatttaccgccactcatactcataccaccttttttattcatatttcctatcatggcattaagtaacaatatcgcccatgctgtatagaaaccattgctatgcatagttccaccgtgggtaataactgccgcacgaggtccatgagaagtaaactttttagcaagttgaataatagtatcaacaggtacaccacactgctcagaatattcctcgatggagtatgaaaaacaagattctttgaataattgtaaagctgatttagctaaaacctgtgagccgtctttaaggcttatcctgtcttccacaaaaagcaccgcactttggcaatctttggcagctataaatttgcctgtttgtcgatctttcaccaaaatatcactatcgctcaatttttcaggttcgggtaaatcctctatatgaaaatttctaatggcttgcccatactgcttatgatttggatcggcgataaataaatgtgttgcattacaaaaacttacgccattagcttgttgcatcgcaatttcacttggtatagacaaataatcttcgttataacgttcattttcaataatccaacgtaacatggctagtgctaaagaaagatctttacccggaataattggtacccagcgatttttatcttgtgctgcagttgaggtaagctctaaacgaggtgctatcacgacatattcaaaattatcctctgtacgcttcttagcaagctgacgagattgacgtttaaatggatttccggattgtgcaggagaagttcccataaacaaaataaattcaacatgatcccaatcaggtttagcatgagaattattagcaaagtcattcataaatgcaccggatccggcacgataggataaaccacaaaaagagccatgagaggcgaagttaatggtaccaaaactgttgtttgcaaaacgtttcagaagaggttgtcttccttcaggacctgcgaaggttaccatcagttgatttacttttgcaccaaaatcagggtgttgtgcattcactggcgtttgcaaatcacgaatcgcttttaatccatctacatgcccctctccaaatagatctccgccattcacaacttcatcaattaattgctcaaaactgatcgttttccatttaccttctccccttttacctactcgcttaagaggttgtgtaatacgataagggctatttatcccatctaaaaatgcagctccacggacacaagcagtagaacgttgctgtaagccattttcaccagaaacgcttaactctgcttgtttaattgattgattataatcaaggtaatgatctgatgagagcgggtgataaggattaccgttaatacgcaatactttatttttttctaaatctattcgaacccgtaaaccacatagagtccagcaccccatacattgggtattacatactacttgttggctattggttaataaattgccctctttgacttgatattcaggtaataaagaatttccatttatattgtcttgtgttttttgtcctgaagaaccttcaattacgccctttgcaatttcttttactttgggagaataacctgcaacaaaagcagtagcggcagttgtagccaaagctccttttatcaaattacgtctttgtttattcatgatcttttctccccaaatttgattgcaatagtgtatgagatagcagttgccataaaataatacctactaatgaccacaagctaaagacagctatcattccaattagcccatctacgttccaactcaattgatatggatttaccaaagcgttatattttgcgatttgctgtacttcaattaataaaatccaacgggtaagccaagtgatacaaagtgcggttaatattcgtaataaccttaggaaagttgaatgaggcaataacagcaatatgaacaaaacgaagatcccgatgagtaataacatcggtgaatagctaatttgccataatttcattaaatgaatagctgtttgctcagaaaatagataaagccctaaaatagaaaccgttaaccctaataaactggcgatagtaaagtatctgagagcataaacttgaggtataaaataatgacaaaataataagctgacgggtaaaacactaaatacgagcaaaggtaaaagccaagtgtgatgccataaaggacgagcctgtacagtgaagacctccatcgtggtatacattaaaatcaatattgtcataattaaagaaagccaaacaaaaaagactttaattaaatcagtattgaatttcccccaataaagccagtgaaaatacttaggaatagattgcattggaactgaggtacgtaatgaacataaaaaatatcctgccacggataaaacaaagaaaggtaaaaaccatgctccccaatacatccaagaccatatcgttgggttcaaataaaaattcataatacgacccggttgatgtaaatccgcagttaaggcaataggtgcaacaattgcacaactgaacgctaagctaagagcaagcaattcaagacgtgaatttttaataaaatgaaagaagaacgcagtcaaaacagatgaacaggctagtccaataaagaaaaaatagcttaccgcccaaggtagccaagcaatagcttgtggttctactaagatctcacgaataatcattctgctttctccttatcttgccataacattggttgaccgttaacttcattcacaaaagcatcatctaaacctagataaaatacatgtggaatggtaccgtgatccggttttaaaaccttcaaatcatctttaaattcatctaccattttactaattgtactggttggatcccgtaaatccccaataatacgagctcctcccacacaactctctacacaggcaggtaataatcctgcttctaaacgatgagtacaaaaagtacatttatctgcagttttagtttctgagttgataaaacgagcatcataaggacaagcttgtacacaataagcacaaccaatacagcgtttgttatcaatcacaacaataccgtctttacgctgataagttgcttgtacagggcaaacctgcacacaaggagggttatcacagtggttgcataatcgaggaagtagaacattattggtaatattctgttcattggtgacttcatattgacgtacggtagtgcgaaactcgccaagtggtgtttgattttccaccgaacaactcaccgtacaagattggcaaccgatacaacggcgtaaatcaactaacatggcatagcgatgagcttcattaccctcttttctttccggctgaaaacttgtattcgcttgagaaaaagggataaaagcctgcccaatagttagtactgataagtttttcaaaaaacgtcttttgcttatgtacataatcactcctacctctaataaagattgagcattcaagttgatcaattcaggttgtctgaatatcaatgcttaatcttcccactcacaaataaaatatttaataaaattgagttgttacctcttttagcgtattgttaaaaaatctccatgaaaaaaccattgtggttttccacataaaaatatgaggatattgatcttcatcaataaaaggaaataaagtgagaaagtgcggtcagtttttaaaaaattttatgttaataatggctttattgccccagttagcttttgcacaatcttggaaaatcggtattttggcacagcgaggaattgctgaagcacatgagcgttggcaaccttggattgattggctaaatcaacaatttgatgaacataaccaattttcattagttactctcgatcttaatgatctagagacagaacaagcacaaggagttgactttattttaagtaaccaatcccaatttttttatttaaataataaggaagttcgttggttggtaacattaaaatcgctaagacaaaaacaacatgacagcacaggaagagttggtagtgctatttttgttcgtagtgaaagtaatttttatcaattgaaagatttgaagaataaacgtataagtgcggtaggaaataaagcatttggcggatttttattaggttataacgaattatataaccaaggcttgatggaaaataaagatttcaagccggtttttacgggatttccggtagacaatacactattttttttaaaagagaaacaggtagatgcggcaattgttcccgtttgtatttttgagcaattggtaaaagagggaaaaataaaggctgaaaatttccgtctattggcagaaaaacctaaccacattggttgtctggcgagtacagtcttactacccaattggtcattagctgcaatgccacaagtacccggtgacttggcatcaaaattaataaccctattgcttaatcaagcgtctgataatcttccgcaatggacacctccatattcaacaaatcaagcggataatatactgcatcagctatataaacacccgaaacaaaatttatggcaagcaataaaatattggttctcacaatatcaattttggattactggtattattctgcttttattcgttaattatatttggataaattggcagatacatagaaaaagtaaagccttacaacaagcgtatcaacaacatcaaaaatatgaacaacagttgatacaggctgatagactttctattcttggagaaatgagtgcaggtattgctcatgaaattaatcaacctcttactgctattagaatgtatgtggaaggtatgaaatatcaagcagaagaacaaagaactcaaatcgtattggataaaatattacaacaagtagatagaagtgcggagattattcataacttaatgaattgggtaaaaggaaaaagtagcgaagatattgagttaatcaatctcaaacatttactaaaaaaagtgactcaattcatttctctacaacattataataaatttcaaattaatctagtttgtgcaacagatatttatttggaaataaaaaccacaattttagaacaaattatctgtaactgtttattaaatgccttacaagcaaaagcatcaatgatagatattatagtagagaaagagcaaaaagaactaaaaataagaattttggataacggaacaggttttcaacaaatagagttggattttccttttgttcctttccgcacaagtaaaaaacaaggattgggcttgggattagtattgtgtcaacgtctaatccaagcgatgaacggtaatataaagctatcaaatagacaggatcaatctggggcagaagtgaccttaatcttacaaataaaaggaaaatagtatgaatattcatctacttgatgatgacttaacaatacttgatgccgctagttttttattggagcaagcaggttatcaagttaaaacttggtctaatagtcagcaatttgtacaacaagctaatatttttgaacctggaattttgttattggatatgaaaatgcctcatttagatggaaaagctgttcatcaatttttacagcaacaaaatagcccttttgctgtaattattatgacaggtcatggcgatatccaaatggcagtacaagaactcaaattaggtgcagtagattttttacaaaaacctatgcaatttagccaattacaatcagccattaaactggcgagaaaaaaaacaatggagaattatgaacaatatcaaatcaaacgatgttataagcaacttagcactaaagaattagaagttttatctttattattaaaaggttatattaatcgacaaattgcagaaactctaaatatatccgtcagaacagttgaagtacatcgttcacatattatggaaaaaatgcaagcacaaacagtggcggaattaatctacaagatcactcttattaaaaaggacgaataatattcgccctaatgatgtagtctactcaatttataccttcatttgcagtctaattgcatcagcaaccaattagcttttgcacctaatgcttttaactgattttattcaatactttcacattatcaaaccctttctctcgaagatatagggcttgtaacttactcatcacccctcgttcacaataaagaacataatttttactttgatctaattcagcgaaatgtgaagataatttataaaaaggcattaaaataatattctgtcctgagatttccagtggtttatcatcgacttcctccggactgcgaatatctaaaatcacctcattagccgataaaaccgttatttcatcaacttcagatacttctttttttgtttgttcggcaatttgacgaatatctaaatattgtgcattttgcaccgcactttccagcacggaaaaatcaaaataactttcttcctgttcgattttttcttttacagcttttactgtcggacttttagaaatggcaccgcaaaattcaggcatagatttagcaatgtcctctgtaccaatttcttttgccttagcaataatttgttctttgtcatgcgtaattaacgggcgtaaaactaaactttcagccacctcatcaattaagcgtaaattagttaatgtttgactcgacacttgtcccagtgcttcccccgttacaatcgcttgaatgccgaaacgttgtgcaactttacttgccgcacgcaccatcatacgttttaacacaacacccatttgtccgttatctactttttctaaaatttccgcaacaacctgttcaaaattaatagcaacaaatcgcactttatgcgaaccgctaaaacgcttccaaatatgatacgccatttgtttcacgccaatttcatgagttgctccgcctaaattgaaaaagcaataatgtactctcgagccacgacgaattaacatgtagctggatacaccggaatcaaatccaccggaaataagcgataaaacatcttcttgtgtaccgataggataaccaccaatcccctgatgacgagctttaatcaacatcattttgtcattttcaatatcaattctgacggtaacatccggtttgctcaactgcacttttgcacttgcaacggcttgatttaaacctccgccaatataacgttcagcatccaatgaactaaaatcatgttttcctttgcgttttactcgtacacaaaatgttttattctcaatctgagttgctacatcactcaaagtttgctcaaaaatatcgtgcaatgtgacaaaaggtttttcttccacttctaagaaatgatgtattccgggaatacgtccgagtaattcaaccaatagtgtccggttttctatattcttcgaccgcacttcgatgtaatcccaatgtttaactactgcaacagtatcatcatatttatttaatacattgcgaatattaccggttagaattttcacgaaacgtttacgtacgctttcgcttttaatcataatttcaggaaaaagtttaataataaatttcataatgagtttacatagctttaatttgatgattttcagcacacgtttcgcatactgaattgccttaagtttcgtgacatattagcattcatgccaaatgatataaattaatttttcatttgctatataattttattcataaaatacagtacaatagacaccctgatttaagatgaagcaaggatgattaatatggcacagacacttgacaaaaatgcaactgatgaactcaactttgaaacaaccctcgctcaacttgagtctgttgttcatgtactggaaaatggcgatcttgctcttgaagacgcattgaaagagtttgagcggggtattcagttggctcaagccggtcaacagcgtttacaacaagctgaacaacgcattcaaattttattgcaaaaaagtgaaaatgcagaattaagcgattatcaaccaagtgaataaaatagttagtttctaatgtatcaatttgctcaagatctccaagaatccaaacaacgaattaatttttttttagaaaaacaattcgagtgcattgatagttctccatctcctttagctgaggcgatgaaatatggattattgttaggtggaaaacgtattcgcccctttttagtttatgcaacaggaaaaatgctcggagcgaatttaattcaattagattatgcagcagcggctattgaagctattcatgcttactcactcattcatgatgatcttccggctatggataatgattcactccgtcgtggacacccaacttgccatattgcctttgatcatgctaccgctattcttgccggcgatgctttacaaccttttgcttttgagctgttaactcaaacacccgatttgtctgccgaacaaaaattagctttagttcaaactttagccaatgcttctggtgttaaaggtatgtgtttagggcaaagtttagatttaatctcagagaatcaacaaattaatttatccgcacttgaaaagatacatcgcaataaaacaggtgccttgttgtcagctgcagtgaagatggggtttatttgttctccgcactttgcaaatataaaattagaagaacaattaatgcactactcctctgctgtgggtttagcttttcaagtacaagatgatattttagatattgaaggtgaaagtattgtgattggaaaaactgccggatctgatctccttgccgataaaagtacttatccaaaacttataggtttagatggtgcaaaacagaaggcacaagaactttatcatcaagcactacaagaattggatgctttgccctttgacacttcagcattgcatgcactcgctgagtttgtcgtaaatcggcaaagctaagtgcggttaaaataaaaatggaataacaaataatgaataaatatccacttctctctctaattaattcacctgatgatctgcgattattaagtaaagacaaattaccgcaactttgtcaagagttacgtagttatttattggaaagtgtaagccaaagcagtgggcatttagcctcaggtcttggcacggttgaattaactgtagctttacattatgtattcaaaacacctttcgatcagttactttgggatgtagggcatcaagcctatccacataaaatccttaccggccgtcgagataaaatgtcaactattcgtcaaaaaggcggattacatccatttccttggcgtgaagaaagtgaatttgatgtgttaagtgttggacattcatccacatctatcagtgcaggtctcggcattgcgattgccgcacagaaagaaaatctcggacgtaaaacaatttgtgtaatcggtgatggtgcaattactgcaggtatggcatttgaagcattaaatcatgcaggctccgtacatacagatatgttagttattttaaatgataatgaaatgtcaatttcagaaaatgtgggggcattaaataatcatctggctcgcttattaagcggttcaatttattctactttgcgtgaaagcggtaaaaaaattctttcaggacttccgccgattaaagagtttgtcaaaaaaaccgaagaacatgtcaaaggtttcgtttccccagtgggaaccctgtttgaacaactcggttttaattatattggacctattgatgggcataatatccatgaactcatatcgactttaaaaaacatgcaatcattgagcggtccgcaattcttacatatcaaaacgaaaaaagggaaaggctatgctccggcagaaaaagatcctattggctttcatggagtacctaaatttgatcataaattaggggaattacctaaatcctcaacgacgccaacttactcacagatttttggcagttggttatgtgaaattgcagcacaagatgaaaaactgatcggtattacgccagctatgcgtgaaggctccggcatggttgagttttcgcaacaatttccacagcaatattttgatgtggcaatcgcagaacaacatgcggtaacttttgccgccggtttggcaattgcaggctacaaacctgttgtagccatttattcaacgttcttacaacgagcctatgatcaacttattcacgatgttgccattcaaaacctacccgtgctatttgctattgatcgtgccggcatagtaggtgcagatggacagactcatcaaggtgcattcgatttaagttttatgcgttgtattcctaacttggtgattatgacaccaagcaatgaaaatgaatgtcgtcaaatgctctataccggttataaatgtggaaaacctgctgctgtacgttatccacgaggcaatgcaatcggtgttaagttagaaccgcttgcagaactaccattgggtaaatcaaagctgattagacaaggtaaaaatattgctattttaaactttggtactttattgtcagaagcaacaaaagttgctgaagatcttgatgcaaccgttgttgatatgcgttttgttaaacctttggatactcaacgtattcaagaaattgcacaaactcattctttaattgttaccttagaggagaatgcaattcagggtggagccggaagtgcggtagctgaaactttatatcagcagcaacaaaaagtttcattattgcaattggggctaccggataactttatccctcaaggtacacaaaaagaaatgctggctgagttaaaattaaatgctgaagggatttttgaacaaataaaacaatttttgcaaaaaatttaatatttttatgaactattttttatgttgatagtcttatagatcgctagtgcactgcaattgcagttgtctttttaatgttaaagtttcttatattaagacctccccgctattcaatctttgaatagcggttttttcttttttaacactcaacagctataaaagagcggtgatttttacaagtaatctgtaattggacttgactgataaccttaatgtggtaaaacaacgctttcaagtattttggaaggaagatgaatatgtatgaaggactgcttattgtattggttccaatgttcattggatatttaatcaaaacaaaaaataccgcacttttaacacgcataaatcatattatgatgatattgttatatatgatcttattcgtgatgggattttctctaggtcaattggatgatttagcgaaacaactaccgataattggtatctccgcctttacttttgcgttaactattcaaagttgcaatattatggggctgttaatttacgataaattaaatcccagtccattaccccatctcgccaaagaaatgccttctcgttggaaattacttcttgacagtgcgaaactttgtgcaatggtgttattaggctttgtgatcggtttatcggtaaaaagttggtttatgttaaaatttggtgcaagcacttatattctaataactttaatttttttcgtcggattacaattgcgtaataatggtatctccttaaaagaagtcttctttaataaacgtggactttatacaggtattatcttcgtttttacttcgttgttaggcggaattctttctgcttatattctcgacttgcctattacacaaggacttgccatttcttcgggatttggttggtattctttatccagcgtaatcattaataatgcttggggacctgtttttagtagcatcgcttttttaaatgatctatcaagagaaataactagcttatttattattcctttattgatgctaaactaccgctctaccgcagtaggtatttctggagcaacatcgctggattgtactcttcctattatccaacgttccggaggaattgaagttgtaccgttagcaattagttttggttttatcactaatattcttccccctattttattggtctttttttcctccatcccaatttagctaaaacgagagtaagacgataaaagtctcactctcgttttataagataaaatcatttttcatataattactcgactgctccgataagttaggaaaataattgttggctatttatatttatattcatcttgatagaataaacgagttaacagtaactttgatatcttatgtggggattagttaatatgatgaataaaaaaaatagttatagttacgaagatttgttagcttctggaagaggtgaattatttggtgaaaaaggacctcagctaccagccccccagtatgttaatgatggatcgtgttgtagaaatgaatgaggaaggaggattgttcaataaaggctatgttgaagctgaattggatattaacccgaatttgtctttctttggttgtcattttatcggtgatccggtcatgcctggctgcttaggtttggacgctatgtggcaattagttggattttatcttggttggataggcggtcaaggaaagggacgtgccttgggtgtaggagaagtaaaatttaccggtcaaattttacctacggctaaaaaagttatttatcgtattaatatgaaacgtgtaatcaatcgtaaattagtcatgggaatggcggacggtgaagttgaagttgacggtaaagtcatttacacggcaactgatttaaaagtaggattatttcaagacacctcaacgttttgattaaataattgctattgtgttaaaaaattgtagtttctgcgaattttacatttatagagttatctagtttaaaaaagtgcggttatttttattaaataaccgcactttttttattacttcaattcaccacaattcaaacaatataagtattgccctttgggatcattaaatttatttaaaatacctaattgctcagtcattttctgcattgatgtagaaaagccgaataaatgggcaatatactgacgaagattatgttctgaatgttgtttagcatttttcatcaactcccccaataatgacggttctttttccgttagccaaacaacagaaaaatcttttatttcttctgaagatttttgtatcactaattctctagctttttcgactgcatcatcaaaactgcccagttgatctaccagtttatacgtataagcatcaaaacctgaccaaacttgaccttgagcaattttatcaacttgtgtttttgataaattacgcccacggctaacaacatccaaaaattgatcataaccatgctctatttctaattgaataatctcactgctgattttagataacgggctgaaatgtgatttcatcaccacatcagttgtcgcaacaccatcggcattcacaccaattttttgcatagatttttcaaacgttggaaacatggcaaaaataccgatagaccctgtaattgtattagggtcagcaacaatataatctgccgttgaggaaatccaataaccgccggaagccgccattgcccccatcgaaacaacgactggctttcctgatttttgtaaattatctacttcttggcgaataatttctgaagcgaacgcacttccacccggactatttactcgcaatacaaccgcttttatatttggatcatcattcgcctcacgtaataattgtgctatgctatctccgcccacattttgttcatcactttcgccatcgacaatagccccttcaacatttaccacggcaatagcaggttgtgtaggttgtgcaaatcgatttttcaatattgccaaataatcctcaaattcaacaaaatccaacttatcatcagaattaactatccaacgtttaatgattttttctcgttcttgcgttaccgctaattctgttattaaaccacgctttttcgcatattcagtttgatttccgttcagtgcttttaattcactaaggtatgttttactatccggtaacacctgtgctaatggaatatcacgattttcagccacaatttgctgataacttttccataattggttaagccaacggcttgtattttcacgacttttttctgacattttatcgagcataaacggttctaccgcagatttataagtacctacacgaaaaatatgcggtgtaatttccaatttattaaatagcgatttaaaatacaaattctctgcaaccataccttctatcgccacttcaccttgtggatttaacaaaataacatccgcataacttgccaataaatattgactttgcgtatagttatccgcataagcaatcactggtttcttgctggctttaaaggcttgaatagctttcccaatgtaagttaacgcaggaatatctttcccatcaaaataattgagatcaagaacaagtgcggtaatttttggatcttttttagccgcttgaatggcattaacaacatcaaacgttgagatttttctcggtacatgttgattacctaattccaaaagaagctcttgccatgccgtatcatcgctacgattatctgccaaatagccgtccaaatttaatagcaacgcccctttaaaatgagttaaatctactttattcgacatactcgaattaaccgaaaacactgctacaatcaataaaacgaaaaaaagaaatactatattcattacaacacgacgagcaaaattgagcatttgccagcacaatttgagaaaggtcaacatcactttcatattatcctttactaagttaaaacaaatgtcgtaccttaccacaatttccttttacttcatatcgatcaaggtaaaaatgtgctagaatccaccgcacttttaagatgaaaaacaagatggaactaaaatggatgctctacaacttcttaccactcgtcattcagaaaaaaaattaatttcacctgctccaactcggcaacaacttgaacaaatttttcaagctgcactgcatacaccggatcatggaaaattacacccctatcgttttgttgttatagaaaaggaagggttgaataaatttacagagttactaaaagaagctgttttggaattagatcttggacaagagcggttaaaaaaagccaagaatttatcccaaagagcaccgatgatcatcggtgtaattgccaaaataaatcctgatattgaaaaaataccggcatgggaacaaatgattaccgctggttgtgctgcttacgctatgcaattagccgcaaatgcacaagggtttgataatgtttggatcagcggtccttgggttaaaggctctgctttgcgtcaagcctttgattgtgaaaaaaatgataaaatcattgcattattgatgcttggtacagcagaacaaaaaagtgatcgaggaaatcgagaattgaatttagataagtttgtgcgttatttatagattttatgtagcccaaattttcactgggctaaaatctccccttataattaaaaaataaatataactcatttttttaacaaggttaaaaactcttttctggtttctctgtcgtccaaaaatactccgccaaaagccgatgtcacagtgtaactattggtatctttaattccacggcattttacgcaaaaatgcgtagctttaacataaacggctacatcttccgtttctaaaatggtttggaatgccaacaaaatttgttgcgttagacgttcctgaacttgaggacgttgtgcaaaaaaagcaacaacacgattaattttagataaaccgatcacccatttttgcgggtaataagctactgacactttaccatcaatagttacaaaatgatgttcacaagtactggttaaagtcacatcatcaactagcaccatttcacttactttcatgcggttttcaatattagtaattttagggaaattagcgtaatctaaaccactaaaaatctcatcaataaacatttttgataaacgtgccggtgtttcttccaaactgtcatcagataaatctaaaccaatcagttttataacctcacgcatatgttgttcaataccttgacgacgttgatctttatcttgcacaagatcaatcattggtgtttcaattcctttttcaaccaaagcattacgaaccttaatcgcttccggagataaattgctcatgactacttcccgtaaaatcgttatatcctttaaaaatgcctgacattctagcaaataaaagctgaaatctctatttattaggtataacaattactgaatttaaagtaaaatgtgagctgttttttcacattattacaaggatttctatgctatctcttgaacaagctttacagcaaatgctttcgcaattagcaactataaataaaactgaaacgctaacattggaacaagcagtggctcgcatttgtgcagaggatattatttcaccgattaatgtaccgtcttttgataattctgcaatggacggttatgcagtacgtttggcagatttgaaacattcaacaacgctatctatatgcgggaaatctttcgctggtaatccattcaacgagcaatggcaagaaaaaagtgttattcgaattatgaccggagcaatgcttcctgaaggtactgatgccgttgtaatgcaagaaaatgttacaataaacgaagacggcacagttaccatcaatgaaatacctaaattgcaccaaaacattcgtcgtttaggagaagatataaaagtgggtgatattgcattaaaaatgggctcaaaattgaccgcacgttcactcccgcttttagcttctttaggcatctctcacgtaaaagtttataagaaacccaaagttgctctattttcaacgggcgatgagcttgtatccgttggacagcctttagtacaaggaaaaatttacgatagcaatcgctttacaattcgattaatgctggaaaaatttccttgtgacatcttagattttggtattcttcccgatgatgaacaacttttcgagcaaactttctttaaggctcaaaaacaggctgatttagtgataagtagcggtggagtttctgttggagaggctgattttaccaaagctgtcttagaaaagtgcggtgaaattaatttctggaaaattgcaatgaaaccgggcaagccttttgctttcggtaaattaaataacgcttggttttgcggactgcccggcaatccggtttcagctttagtgacgttctatcaacttgtgcagcccgtaatagcaaaattaagtggctatacacaatggaaaatgccacaacaattaaaagcaatcagtgctacaaaattgaaaaaatctattggtcggattgattttcagcgtggtttttaccaactcaatacacaagggcaaattgaagtttatcctgtcggacaacaaggttctcatctttttagtgcctttgtgaacagtaactgttttattcgtttggaacaagaacgtggaaatgtcgaagccggtagcatcgttactatagaaccttttagtgatattttaaactaggatctttatgcaaatcgaactctcaacaatagaagaattacgctataaccgtcaaattatcatgaaacaaattgattttgatggtcaagaaaagttaaaaggcacaaaaatgcttattgtcggcttgggaggattgggttgtgctgctgctcagtatcttgcttgcacaggtgtagggcatttaactctccttgattttgatactgtttctctctctaatttacaacgccaagtactgcataatgatgagcgtttaaatatgctcaaagtacaatctgctaaaatcgccctgcaacaactgaatcctcatattgaaattcaatgtattgcagaaaaattgaacgaagaaaaacttgctgaaattgtaccgcactttgatgcagtcttagactgtactgataatgtagaaatccgtaatcagctagatcgctgttgtttggctacaaaaacgcctttagtatcaggtgcggcaattcgtatggaagggcaagtttcggtgtttacttatgaagaaaatacaccaacttaccaacatttaagccgtctattcggtgaaaatacgctaagttgtgtggaagctggtgttttatctccaatagtcggcattgtaggggcaattcaagccttggaagcaataaaagtgcggttaaatataggcaaaatattatcaggacgtttattgatgattgatggtttaaatatgaagatacgtgaaattaacattccgtctgaataaaaactcaatatccttacaatctctaagataatgctggattgcctaaaacacaggtttatcaatcaactgttttcaaagtagcaaagattcaggtagtacgccatcatctccacgatgtacccgcataccttcaacccgcacacgtcccgtcacacaatcagcgatggctcttggtaacaaacggtgttctgcagctaaaactcgtgccgccaatgtttccggtgaatcatcatcggccacaggcacagccgcctgtgcgataatcggtccgcaatccatctctgccgttacaaaatgcaccgtacacccaactacacgacatcctgcttccaatgcccgacgatgcgtatccaacccagtaaatgcgggcaataacgatgggtgaatattaatcaacctcccagcataatgcgtgcaaaattctggcgtaagtatcctcataaagcctgctaaaacaacccaatcaggctggtattcatcgatttttctcatcaaagccgcatcaaaatcgctacgttcaggataatctttgtgactgaccacaccggtagcaataccttgttcttccgcccatgccaaaccagcagcatcagctttattagccaataccgccaccacatttgcaccctcaattcgagcttcaactacagcctgcatattactgccacgccctgaaattagaattacaatgttttgagtgttcatttttttccttcaatttttccttcaatcaacccagccgggattaattgctttgttgagatggcacaaacatcgttttaatcaccgcaacttcagattccccctaaattttatcaacccgtccgattcgaaaaagattctaagtacgaacaacaaagatggtgaagaatatggattggggtagcccttaaaaggctatggctctatggctatggctatttgctattctccacccatttaccatcaacaaaataggcactccattttgttgttttaccatttttctctgaggtaacatattgacgtttttctttacgactaaagcgaataattgcctcattaccttcaggatctttaactggcgcatcagctaaatagcgtaatttttccggcaggcgatcttgatattgagccaattcagccacttttgcaggacgactttctcgtgattttggaaaattatgtgctgacataaacacaccactcgccccatcacgcaatacaaaataagcatccgatttttcacattttaattcaggaaaatgtacaggatcctcttttggcggtgccacttccccactttttaaaatcttccgagtattatcacaattcgtgcagcccatatatttaccgaaacgtcctaattttaagtgcatttcaccaccgcacttatcgcattcaactataggaccttcatagcctttaattttatattcaccttgttcgaccaaatagccatcgcaatttggattatttccacaaatatgcaattttcttgtcgtatcaatcaaataactgtccattgcagtatcacatttcgaacaacgcttacgttccattaaggcttttgtttcagagctttcatctaaaacatttaataattccgcttccggaattaaatttattgtggttttgcaccgctctttgggaggtaaggcataaccggaacagcccaaaaaaacaccggtactggcagtacgaatagccatttggcggttacaagttgggcaacctatatctgttgcaaccaaactatttggtttcattcctccgtccaattcatccaattcagcttgtgttaattgttggctaaaatctttaaaaaattgatttaattcttctttccaatttttcttaccgtctgcaatttggtcaagtatattttccatattagcagtaaaatcataactcattaaatcagcaaacgattggttcaatcgatctgtgacaatttcccccattttttctgcataaaaacggcgattttcaactcgaacatagcccctttcttgaattgtggaaataattgccgcataagtagaaggacgaccaatccctcgtttttccaattctttaactaaggcagcttcactaaaacgtgctggtggtttggtgaaatattgttgaggttcaaccttagttaaacttaatttctctccaactttcactatcggcaactcttgatcttcagggtttctattcgattgaggtaatacttttgtccaaccatcaaagcgtaaaacacgtcctttggcttttaactcataatctcctgattggacggttacggttgtactgtcatatttagcggctggcatttggcaagcaacgaattgtcgccaaatcaaatcgtataaacgcactgcatctctttccattccctctaaactatctgccaattgtttcacatcagaaggacgaattgcttcatgtgcctcttgtgcattttcgttactggaatagaaattcggtttatccagcaaataggcttgtccaaattcttgcacaatataattacgcaccatttctaaggcatctttacttaaatttgtgctatctgtacgcatataagtaatgtaacccgcttcatataaacgttgtgctaacatcatcgttttctttacgccaaaacctaattttgtgctggcactttgctgtaaagttgaagtaataaaaggtgcttttggttttgacgtcgttggttttatttcaagatctttgacgaaataatcggaaatttgtaaaaaatctaccgcacttctcgcctgttcgatatttttaggttcaaattttttcccttgaaattgtactacatctaaacgaataggtcgtttttgactgtttttactatcaacagaaatttcccaatattcttgaggttgaaaagccttaatttcacgctcacgctcaacgactaattttactgccacagattgaactcgaccggcagatagacctcgtgccacttttttccaaagtaacggtgataccataaaacccactacacgatctaaaaagcgacgagtctgttgtgcattaacacgatctaaatttaactgttcaggtttctcaaaagcttgtttaatcgcatttttagtaatctcattaaatactactcgactaaaacgactgtcttcaccgccaataacttcgcgtaaatgccaagctatcgcctccccttctctatccaaatcggtagcgagataaatatgatcaactttttttgctaaagatttgagttcagaaaccactttctctttaccgggtaaaatttgatacttagcttcccaattatgataaggatcaattcccattctttttaccaacgcattttgctctttttccgtttttatgcgttgtttttcttccgcacttaatcccttcgttgaaataggtttcgctttttcaccgctactttcacctaccgtaggcaggtcacgaatatgccctacactggacttaactacatattgattacccaaatacttattaatagttttcgcttttgccggcgactcaacaattactaaggatttactcatatttttatttacctaattcgctgtatttttgtaaaattgcccgctatattgcttactatcttttgcaaggtcaacagttttttataaaaatgggtataaatgaataaactaaatgcagtttcaatcatctgtaaagttattaaaatatacagaacttttaaagctacaacgtaacaaagcatttaccccatcatgtttacgctaaactaaaagcattgattcattttgttatcaacttatatttgtactaaacgacacgctaaaaataaggtaagttaccttattttccctcacttccccagcgaagaaataaatcttgttctaattcaataccaaattgatcacatacacgattgacgctttggttaataatatcatctaagttactgggtttatggtaaaaagcgggcattagaggggtaatctgtgcacctatttctgccgcctgagtcatcaaacgtaaatgtcctaagtgtaaaggtgtttcacgtacacataataccaacggtttacgttcttttaagcatacatcagcagctcttgtcattaaatcatcggtatagctatgtgcaatacctgacagggtttttattgaacaaggcaaaattaccatgcctaaagtgcggtaagatccggaagaaattgccgcactaatgtcacgaatatcataaactttatcggacaattctcggacttgttgtaccgtaaattgtgtttcaagtgcaatagtctgtttcgccgcttggctaataataaggtgcgtttcaatttccggaagggattttaaaatttgcaacaaccgaatagcataaatggcaccagatgcaccggtgatgccaataattaaacagtcttttttaagcttcattgtgcatttcgagattcgtggcatctttttcacgctttttctttgctttgtcattacgtaaatcggcaacttgatccaaatacgctgaggtaatatctccagtaacataaacaccggtaaagacagaacaatcaaaatctttaattgccggattttcttgctgaacagctctggttaaagcatcaagatcttggaatataagcttatccacaccaatgagtgtagcaatttcatgaacatctcgtccataagcaattaattcatttttagtaggcatatcaataccatacacatttggataacgaatttccggtgccgctgaggcaaaatagatcttatttgctcctgctgctcttgccatatcgacaatctgtttcgaagtcgtccctcgcacaatagagtcgtcaaccaacaacacattcttacctttaaattcagaagagatagtattgagtttacgacgtaccgcacttacacgctgagtttgccccggcataataaaggttcttcccacatagcgatttttcacaaaaccttgtcgataaggtttatttaaaatatgtgcaatttgtaacgcaatatcattagaggtttcaggaatgggaataacaacatcaatatctaaatctttccattcttttgcaattttttgtcctaaattctctcccatatgaacacgagctgcataaacagaaacgccatcaatataagaatccggacgagcaaaataaacatattcaaaaatacaaggcgttaacttaggattttctgcacattgttgtgcatataactgaccatcaaaagtaacataaacggcttctcccggtgctacatcacgaacaaattcaaagtcagcaatatctaacgcgatactttcagaagcaaacatatactctgttttaccgcttacctcatcttcacgttttcctaatactaacggacgaataccatttggatcacgaaatgcaactatgccataaccaatcatcattgcaacacaagcataagcaccacgaatatctttgtgagtagctctaactgcctcaaaaatatcctgcgtagataaagggtgtgttgtttgatccaaatgatgagccaaaatatttaacaaaatttccgaatccgaattggtattgacatgacggcgagcaaaggtaaagagtttttgttttaactcttctgaatttgttaaatttccgttatgcaccaaagttaaaccgtaaggtgaatttacataaaatggttgagcttcagagacactggaacttccggcagtaggataacgcacatgaccaactcccgcattcccttgtaaacgtagcatgtgaacttgctgaaagacatcacttaccaatccatttgcttttcgtaagcgaaaacgattttcttcatctactgtgataatcccagccgcatcttgcccccgatgttgcaataccgtcaaggcattataaatagactgatttacagggctatggctaacaatacccacaattccgcacatatttcacgttccttatttattcaatgttgaatttattaaatttgaatttgcttgtatttgttcaaaaaaccattccacaataaagccaaagtgcggtattaattttgatgttttccaccaatcactctgtgcaaagtttgtgaaagaatcaataaaaaatagcaatgccgccacgattaatatacctcgtagcaacccaaagcaagcacctaataccctatctgttccggttaaacctgttttatcaactaactgactgataatgtagttaagcattgcaccaacaatcaaagttgctacaaataagattgcaatagcaaccgcattacgaacataaggtgcttctatttgagttaaataagttgctaaatagggataaaaattatttgccaccaaaaaagcaacaatccagctggcaagcgacataacttcacgcacaaaccctcgcaataaactgacaattatagagaataaaattattccgataatcattaaatcaagataattgttcattaggtaacctctaaaatcccatcaatttaagaccgcacttattctagcaaaaaaggaaaacgtttgcgtagtctaaattcacgctttatgcaaatttaatcgaaataaaaaagaagaaatcagaattgtcgtctaaaaatatagatggaaatatcaggaaatgtatcctttcagtttaaaatccatctgtctattcactaaaacactagatgagagatgttgagttagtcgataagccgggttctgtcttggacaatcattcatctaggcgtatatttacacatacgctcaagcaacctacccgaactctgagcgggcaactcattgagttcctatttggtcttgctacgagtggagtttaccatgccataaaatgttaccattcatgcggtgtgctcttaccacaccctttcacccttacctgatctcttacgagccattggcggtctgctctctgttgcactggtcgtaggctcacgcctcccggacgttatccggcactctgccctatgtagcccggactttcctctcgtttacttatgcctctaagtcgtttaaaaacggttaaagatttcaacaaaccagcgattgcctgactaactcaatgcggagtatagcgtaaaattcagataaaatatagagttcacccaaaacttgcggtaaaataaccgcacttttcaatgaggaaatgacgatgaattacttacaaatcgctcgaaattcgttagctgccgagcaaaatgctttagctaaacttagtcaaaatttaaatcaacagtttaatcaggttgttgagcttattttaaattgtgaaggacgattagttgttggcggaatcgggaaatccggacttattggtaaaaaaatggttgctacatttgcctcaacaggaacaccaagtttttttctacatccaacagaggcttttcatggtgatttaggtatgttaaagcctattgacattgtgatgttaatctcttatagcggtgaaagtgacgatgttaataaattgattcccagcttaaaaaattttggcaataaaatcattgcattaacaggtaacctgaattctactttagcaaaacatgccgactatatccttgatatcagtgttgagcgtgaagcttgtcccaataatctggctccaacaacttcggctttagtaacgttagctttaggcgacgctcttgcggtttctttaattacagccagaaactttcaaccggctgattttgccaaatttcatccaggcggtagtcttggtcgtcgtttgttatgtagagtgaaagatcaaatgcaagttcgtttaccaaaagtaacagaaaacacaaactttactggttgtttaaccgttatgaatgaaggtcgtatgggggttgctcttgtcatggaaaatgaaaatttaaaaggtattattaccgatggcgatattcgccgtgcattaagtgcaaacggaactaatacacttaacaaaatcgccaaagatcttatgacttccaatcctaaaactattaactataatacttatctgtctgaagcggaaaactttatgaaagagaaaaaaattcattcattagtcgttgtagatgatcagaataaagtgataggtttagttgaattttcgagttaatcccatgatgttattaaatgaaaaattacaaaaaattaagctggttattaccgatattgatggtgtactaacagacggcttattgcattatgatgccaacggggaagtaatgaaaagtttccatgtgcgtgatggactgggtatctgtatgttaatcaaaaatggcattcaagttgcagtcttatctggtcgagactcccctatcttacgtaaacgcattgcagacttaggcatcaatttatttttcttaggtaaattagaaaaagagagtgcttgttttgaattaatcaaaaaagcaggtgtaacacccgaagaaactgcatacattggtgatgatagcgttgatttacccgcattttccgtttgcggattgtcttttgccgtaaatgatgcgatggactatgtgaaagattgtgctgatcatattttgagtttaccaggggggaaaggtgcctttcgagaaatgtctgatatgattttaaaagctcaaggaaaagcaagtgtctattccacagcacaaggtattctcaaagcagttaacaagatggtgcaataaaatagataatgaaaataacagtccacatacaaaataagcggactgttacttgtctgtaaaatatctctaaacacaactaaaatccccgcaagcaacgtaaaaaatacttttcacattctacccattcattcattaatttaataaccacattatcgatcaccgcacttacataagctaaaccttacatcataattacctattcgtattctaaataacaatagttattattaaaaatacccttttaaattaataacttataaaaaaataaaagttgcattccatgaaaaactgattaaaataaaacctgttttattcatcaataaaaaaggaactcgctatgctaaatcaagctattattactaagttaaatgaacaaattaacttagagttttattcatctaatgtatatttacagatgagttcatggtgtgctcataacggctatgaaggtgcagctgcatttttacttcgacatgcagatgaagaaatgcaacatatgcataaattatttacttatgtaagtgaaacaagtggtatgcctctgttaggtaaaattgaagcacccaaaaatgattacaaatctttaaaagaaatttttgaaataatcttagaacacgaaaaatttgtaactagtaaaatcaatgaattagttgaaattacttttgcaaccaaagactattcaacatttaacttcttacaatggtatgttgcggaacaacatgaagaagaaaaattatttaccggcattattgataaattcaatttgatgggcgaagacggtcgttctctttactttatcgatcgtgatttacttactttataatagataggacaaaaatatgttatcagcaaatgttatcaaattattaaatgatcaaatgaatttagaattttattcttctaacctgtatttacaaatgagtgcttggtgtgagcaaaacggttttgacggaacagctaaatttttagccgcacatgcagtagaagaaatgcaacatatgcgtaagttattcacttatttgaatgaaacaggtgcttcggcaatcattacggctattgatgaaccgccacatgaatttgattcattaaaacaagtaattgaactaacatacgaacatgaaaaactcattacctgcaaaatcaatgaattagtcggaaaaacctttgaagagaaagattattcagctttcaatttcttacaatggtatgtagcagagcaacatgaagaagagaagttatttagtggtattttagataaaattaatcttcttggtgaagatggtaaatgtttatatctaatagataaagaccttggtgatttgacaagtaaagtataatctatagaagatcaaatctaatctgacagtccctgtttaaaattatcatatctgtcagattagtttgagcttaagttttttctatctaagtacattttccatcaagtgatgttgctattaatctctcacttaagcacgtttttgtgggattataataaaggtctctttttgagttgctataccttttaccaaaatgagtaaaaaaataatcatttgtagaatcatactaatgacagtttaaagatatcacttgatagtaattgacaatattcagtagacagtcctttatctgtgataatttgtgtaaagttattaagttgagtcgcacaaaataaggaatattttccatatttactgctatcggcaactaatactttttgtttggcattttgttggagcattctttttaaatgggctttctcttctgtaggtgcggtaacacctttttccaaactccaagaattacaacttacaaaagcaatatcaggattaatgttattcaataaaatcaggctatggttaccgatacaggattggctactattatccactcttcccccggttatggtcaattctatttgtttatattcggaaagtaataaagcgatatgcagatcagtcgtaatcactcgaagtggcatatgagcgattttttttgcaatgcacaaagttgtagtacctgcatctaatacaatagagtctcccggagaaatgagagaaacggcatattcggctatccgctctttttcagtaatttgcttaagttgcttttcatttgtagttggttggaatggaataaaatggtttaaacttactcctccgtgtgtacgaattacaacaccttcttcatctaattttattaaatcacggcggatagttgcaggagaagcatcagtaacctttaccagctgttctacggtagcaatattatgactttttagaaatagtaaaatctgttctagacgatttttagacatataaactctcttatttgtaattattttactataaataattttttgaaaataagatagtgaaaattaaagaacctaaaacattattgctttaggttctttagtattatttctccattatgtggcttaaaagtacttcgcttccaaatccaccggatttggtcattacaacgatgtctgaatagttaccttcttcaattgagcataaaggcactcccggtactactgcatataatacgttcatttcagttacattcatttgctccaataatgctgcagccccatctccaccgaatagtataagactatcaaatttttcattatcaaggcagaatttacttaaatcagctaagtgttgagaaatttctttagcggtttcagtaatatttgccgattttgcatttacgacttttgctgggtttgctcgaataatcacattatccttactaaaacgtattagagcgtttaattgtagttttagtgaatgttctgactgcgaatagttcatcaactgcgaaggtgaaggatgaaatacaatcgattttccacctaaagttgaaacatattcatcaacttgaagctggcttgtttcgtggattgatgttactacaattaatgttctacctaatgtaatctctcgctttggtctcggtttattttgaatatttttcaatttctgtgctaatccagctgagccaacaggaataattttatttcctatatggtttataacttttgcaataattgcaagatcttcgtgcgttttagcatcaataacgatctgtttatattcactattttcaatagatgcctgcaaattatcgaccgtatcacacggaattacttgagcatcaggcaataattcttgcatagaggaagacagtacagggcaaataggatctttgcctgaagcggtttcctttacaggaacactattaacatataaatgaccggcttctatcgttctccccatttctggatatgcaggacaaataattgctttaacgtccggatataaactagcccacgcttcaatagcaccttcaatttgatattttacagagcctctcattgtagaatcaattttgaggtaaatttgcccaataccattttggatagcattactaattgcaatttgagtttgttcttttgccttttctccaatagctcttgagtcagtagaaacagaaattacttgagctttatcagattgcatttgtgctaatgccgaaactttagtttttaagacagtgttaaatcctgcttcagcaaacataactgcggtatcatttgcaccggtaagatcatctgcaataactaagagagtttctttcatagcttttccccttttactgtttcttgtgctaatccaccttgacgttttaaaacccaagccgcaaataatggagctaaaacagcggaaactaatacagcagctgcaatttgtgcagtagcagtttgcacaaaaggtgctagtgtagggtcagcttgagcaacaatttcaggtgtaattatggcatttccagcagtagtaccagcagcaaatccaatccctgattgattacctcgtcttaaaatagttttgtaaccgataaacacaaggaaacctgtaaagagagaagctactatacctaaaataatacctgttgctccaccagtaataatggcttgtaagttaatacctgtacctaatgcgaaagcaaagaaagggataacaatagcactagttggtttcattagttctgtccatttaggatctaagttaccaataaccataccaacaatcagaggaataacagctgcaagcatcaatgagaaaggaatatcagctaatcccgatacacctaaaaatagtaaaacaaagaaaggaccgtcattaactgcagaagcaatataagcccctttatctctataatcgccatattttcctgtaaatgctaaccaaatacccccatttgaattagccacaacagtaagcatagctaataaagaaacacccataacaccatcatttcccacccataatcctaaaaaaacaactaaaagagcgggtataattgttttaaataataatacaatgccggtatgagcaagaacaggaccggaacttctcacagtaatttgcatacctgttgcgaaaattaggagtgcaataagtgagcctgctgatgatttgaataaagctgtcgtaaatgaacctaaattcaaaaagtcaggcaaaaacgtaccaataatagaaccaaaaattagcgatatgaccattgccccaccgggaattttgttcataccatcatatattggaacgatggatttagatacttgagtagacatattaatctccttagtgtgttgcatatttgatatttgccatttttgcacctagatagagtgcttcagacatactacggctatcggcaactccctttcctgcaatcggaaatgcagtgccgtgatcgacagatgttcgaataaatggaagaccgacagtaacatttacacctgtatcaaaacctaataatttgatagggatatgtccttgatcgtggtacatcacgacgacaatatcgaactcgtttagattagctgcacgatgaaataaagtatccggtggtataggtcctgtaacattaaatcctttggcttgagctgctagaattgcaggtacgatttctttttgatcttcatcaccaaacattccattttcaccagaatgagggtttaaaccggcaacagcaatacgaggctctttaaaaccaagaatacgagcattttcttctgccaaatcaataacagtggcaactcgttctttagtaactaaatcacaagctttacgaagttggacgtgagtagtaacgtgaataacgttgagtttttcgctggttagcatcattgagtaatctttagtattactaagggtagctaaaatttcagtatgaccgggaaacattttaccacttgcatgtaatgcctctttatttaaaggggctgtaacaatagcttggattttcccttccatcgctaacttaacggctttttcgatgtattcataagccgctttaccagcacgaggatcaatttgagcaaaaggcaaatcttctgataagttattcaaatctaaaatatcaataacaccatactctgccgtaaagctatctagatcatttaatattcttaatttcagttctgaatgaacaataggtaaagctcgttgcataattttttgatcgccgataacaactgggtgtgctaactcataaatccgtttatcagccaatgctttaataataacttctgggccgatacctgcggcatctcccatcgtaattcctaaaataggtttcatttccactccttgattgaaattaatcatttttagcaaattatatcgcaaataaagagataaaaatgtgattaaagtcaaaaaatgatcttttttaatcgcattgattttatttaatctaaaggtaagggttataaagcagattagaaaagtaaaatgttatttaatttgaataaacacttccctttttagcaaaaaacggtatcattacgcctcttaaatgtaaccctacatttaagtttgtttccaacctatcctatcttgggacaaatagggtaaaaacaaaaaagctggaacgctttttttaataagtagcgagtcaaatgccccatggcgtctagtctctctggatttgagagcttaggcttcctccgcaaggcacccgacttatttttttcacctcttttagaaggtttatttcaatgacaattaaaacccctgttcaagcaactcttgcttcaaatcaatactttttagatcgccaagatataatggaatcaaacgtgcgtagttacccgcgtaaactgccgtttgcttatcaaaaagcacagggcgtttgggtaactgatgttgaaggtaatgaatacctcgatttcttagctggtgcaggaacgcttgcattaggtcataatcaccctaaattaattcaagcaattaaagatgttttagacagcggtttgccgttacattctttagatattaccactccattaaaagatgcttttaccgaagaattactctctttcttccctaaggataaatacatcttacaatttaccggtccatcaggagcagatgctaatgaagcggcaataaaattagcgaaaacctatacaggtcgtggcaatgtcattgcattctctggaggtttccatggtatgacacacggtgcattatctttaaccggtaacttaggtgcaaaaaatgctgtgcaaggtttaatgcctggtgtgcaattcatgccttatccacacgaataccgttgcccatttggtattggcggtgaggctggtgtgaaagcggttgaacattattttgaaaactttattgaagacgtagaaagtggtgtggtaaaaccggcagcagtaattttggaagctattcaaggtgaaggcggtgttgttccggctccaatcagcttcttacaaaaagtacgtgaagtaacccaaaaacacggcattttaatgattgtggatgaagtacaagccggtttctgtcgttcaggaaaaatgtttgcctttgaacatgcaaatattgaacccgacattgtagtaatgtcaaaagcaattggcggtagtttgccattagcggtattagcgattaaaaaagagtttgatgcgtggcaaccggcaggtcatacaggcacattccgtggaaaccaattagcgatggcaacaggctatgtttctctcaaaattatgcgtgaagaaaacttggctcagaacgcaaaagagcggggtgaatacttaactaaagccttaactgaattaagccaagagtttccttgtatcgggaatgtgcgaggtaagggtttaatgatgggtattgacattgtagacgaacatcaagccaaagatgcaacaggtgcttacccacgtgattgcgatttagcggtagctattcaaaaatattgttttaaaaacaaattgttactagagcgtggtggtcgtggtggaaatgtggtgcgtgtgctttgtgcagtaaacattacccaagcagaatgcgaggaatttattaaacgctttaagcaatctgtagccgaagctgtgaaagcggtacgtggttaatttttgataaaacaagcggtcatattttgcaaaaaatttgcgaattttgaccgcttgaattgtatatagcattgaatgagataacaaaaatgacagatatttccaaacacagacaatcgctattttgtagcgatccacaatctattgcggattatgaaaccgcaatgaacaatgcggtacaagcggtatcaaattggctaaaaaatgaaaaaatgtacaccggcggttcgatcaagcaaatgcgagccttgattgacggcttcaagccgaccaaagagggagtgggagtgcaaaaatctcttgagcatttggtagagattttcctcaacccaagccttaaagttcaccatccacactctttagctcacttacattgcccgacaatggtgaccagccaaattgcagaagtgttaattaatgcgactaaccaatctatggactcttgggatcaaagccctgcgggatctattatggaagagcatttaatcgactggttacgccaaaaagtcggctatggtgaaggtacagctggggtgtttacttcaggtggtacgcagtcgaatttaatgggcgtattgttagctcgtgactgggcgattgcgaaccgttggaaaaatgaagacggctctgaatggtcggtgcaagcgaatggtattcctgctgaggcaatgaaaaacgtgaaagtggtttgctcggaaaatgcacacttctcggtacaaaaaaatatggcgatgatgggaatgggcttccaatcggtagtcactgtgccgtcaaatgccaatgctcaaatggacttagaagcgttagccaaaaccttagcagacttaaaagctgacggtaaaatcgtagcttgtattgtagcaactgcaggcacaaccgatgctggtgcgattgatgatttaaaagcaatccgcaaattggcggacgaataccaagcgtggttacacgttgatgctgcttggggaggtgctttattattatcgaaagatttccgtcatttcttagatggaattgaattaaccgactcgattacactcgacttccacaaacatttcttccaatccatttcttgtggggcattcttgttaaaagacgaggcgaattatcgtttcattgattacaaggcagattacctcaactcagaatatgacgaagaacatggtgtaccaaacttagtagcaaaatcactgcaaacaactcgtcgttttgatgcgttaaaattatggtttacggtagaagccttgggtgaaaatctgtatgcttcaatgattgatcacggtgtgtatttatcaaaagaggttgaggcttacattactgctaccgaaggcttggaaatgttagtacctgcacaatttgcctcagtgctgttccgtgttgtgccgaaaggctatccggcagaatttgtggatacattgaaccaaaacgtggctgatgagctgtttgctcgtggtgaagcgaatattggtgtcacgaaagtcggtaacaagcaatcactgaaaatgacaaccttaagcccaattgctactcttgaaaatgtgaaagccttattagcacaagtgttggcagaatcagaacgcatcaaagattctattgtaaacggcacctatatcccgcctattgattaaacgattggcaaaattatacctaaatcagaccgcttatcagccttgaattgattaatgagcggtcaattttttaactttttacaaattttattgaaagctctattgttcataacaagttaatcaaccattaatttcctcaatacttcacccaacccactttgacgctcagtcgctttactcaccgccatattccatattttgcggtcggaaaaaatagtaacttgattgattgctcttgttactccagtataaaccagttctttacataaaacaggattggcttcacaaggcaaaaccacaaaggtatgggaaaattctgaaccttgggatttatgaatagtcatggtaaatgctggactatgctcaggaatacgacttgctaattcagccttaccattttcaaaccaaaaatgcccttttaagctaccatcaggttgtttttctgctaaatacaacgcaatatcaccattagccaatccgagacggctattattttcagtaataatgattggttttccaatatagaaatcacgactatgattaaattgcacaagtccttttttctttaattgttccgcaataagttgattgagattttcgctccccagttcccctaccctaagtgcggtcaaaaatctcactttattgaatgcggcaaaaatagccgcaatatgcagtttaatcggtaagttattttcagtaattttgtgaataagttgcaaatattcttcataattttgcaccgcactttgcacgaccaattgactgcaatattgagaataatggtgtgctaatggctgttcatcaatattagtttgttcatattgtgtagaataatccactaaattgatttctcccgtgtcgtttgtgttattttcttgttgatattgatgaaataattgccaactttcagcaattttttgttggttaattaattgagctaatttaccaatataaggatgtttaccgaaacgacgactgccctctaagttgcataaacaatcacgaataagattttcatctgcatgatgttctaagttttcccctgttgtttgctgtaaataatctgctaactttgaactaattgaatattgtctaaaagtacctaattcagccaaaatcgctcctgcttcaacagaggataactgatccttatcgccaagcaaaatcagcttacaactcggtttcaaggcttgtaataatttcgccattagaaacaaatccaccatagatgcttcatccactaccaagagatctatcggtagtggattacgtttattatatttcgtcttttcttcaaaaaatcgcacaccaattaaactatgaatagtttcagcattaaaaggaatagcattttttatatgttcactaactttaattaactccttttttgtcaataaattaaaggaatttttcatactaatttttaagcgttctgaagcttttccagttggggcaaccaggcgaataactaattttccctctgccagctcctgtaatgccaataataatcgagtaactgttgtcgttttacctgttccaggtccacctgtaatcatgcaaaaaggttgatgaattgccgttgctacagcaattttctgccaattatgcttttgttttaaactattatcttcatgctctaccgggaagtatttttgtaagatgccttgaattttttctatcggatatggttgattttctttctgttttattgttcgaattaaaaattcggcaattcgatgctcatcttgccatgtgcgataaaaatataggcgattattttgtagcaccaagggctttacctcattaataggatcttgagtaaatgcgatatgattaatgagtaaattttgccattcagattgtgtaatattccctattttctctttaatatcaataaggtaacttttttccgcataaggtaaattaaacagatttctaaaagaaaaattttctatttttaagcacgtatgtccttgttggttatgaaaattacaaagtgcggcaagtaaaatagctaaatttttaacttgtgatgaataatctaattcccgttgtttatctgcaatcaactttgcaaaataataatcaccagcttgaataaatttcctttccttaagttgatacaaaatatttagcattaaaataaactctccaattcagaaatcaaacgccaatccggtttatcaaaaaatatcccggaattatcttttccattcattccacgtaaaaaagtataaagtacaccgccgaaatcacgttggtaatcataatttttatcccgctcttttaaataacgatgtaatgcaatggtataaattaaatactgccaatcataatgattattacacatcacttgaattagattgtcttgctgataatgttgagaagaatagcctagtaaattagacttataatctaataagtaatacttgccttcaaaacgaacgaccaaatcaataaaacctctcaccatacctttaattctatccatcagtatcggtgatgacggtaaatgatgatacttacttaacagccgattaaagacattttcattaaatgattgatttaatttcaaataaaattgcatttcttttaaacaatcttgtggcttgatattgcctaaagtaaagcctgcaatatcctgttttaaaggcgtattaaaaatcgcatttatccattttttcaatggattttgccattcatcacttaattgtaacgtctgacaaagtttagataattggtcatcattcaatgcctgcgtcatattatatttttcaaaataacgatggaattcgctaccaacatggacaccatgaggaaaatcaaacggtgaaaaacctacaggataatcagagtctgcactcaactttatatcaaatgacgctgacatatcatgaccattttctctcacatcatgatctcttgcttgatcaaaaactccggatatttcaatctgctgtgctttttgtcgagaatttaaagatctgttacgttgatgacggtaggtcatttcagtaaaacttgttacagtccaattacgctcaatcttgccatgaaattcttccgcttcaaccggcgacaatgcctgttgcactgtaatatactcatttctccttactaatagttttttatcttcctctatttcaacacattgttcacctaattcctcaattattggacttaacaatttttttgcatcatattcatcatcaattcttttatttacaccaatttgtcccttagttaatacataaagtaacgcattccattttttctcaaaaatgcgaggaagattaataacaatctgatatttcgctcgagtaagtgcaacatagagtaaacggatatcttccgccatacgctctttttcaatttcatcggaatgttgcttatccatatcccataacacttgttcttgattttcatcataataagtattaatggcattatctcggaatagggacggcttacaaataaaaggaatccaaactaaatcataagcaagccctttggatttatgtaatgtaacaatcttgactaattctcgatcactttctaaccgaatttgttcttccaagcgttcttcgccttgaatctgtttctcaaaccaacgaactaaggaggactcggtatcatttaaacgggtagcctgttgcaataactcacttaaatgccacaaatcagtcatttttctctcaccttgttccatcatttgtaaattttcattaattttttcaactgcaaataaatgatgcaacataggtaaaataccctgcctttgccattgttgttggtaagcaataaatcgctcaacacagttttcccataagttctcatcttgcttaatttggaatatttctgcaccggttttagcaaaaagagcggtactcaacgcatttaaaatattattttcatttaacggatttaaacaagctcgtaaaatatgcaacagttcttttgcagtgatactatcaaaaacgttactacgatctgaaagataaactgatgcaatacctttatcccttaaggctttttgtattttctccgcttgagtaaaactactgactaaaactgcaatattttttgcttttagtggtttgttatctaaaatagcttgattttgtaccgcactttgtagccattgctcaatagataaagcacaattttcagcaagttgtgtgtcattgttgtcagtcaaataacctcttaatgcaggttcaattcttccatttaagcaaaatcggttgggaagaagattcccttgagtgtcataatataatcctttagcaacctgttgaaatggaatttttttatgtaaaaaaggagaattttcttgaaaatcaaaaagataatttatcgtctgaataagaggttgtgtagaacgccaattttcgcccaaactaaatcgatattgtgcttgttccgttgctttcagataggtaaaaatatccgcaccacgaaatttataaatagattgtttaggatccccaatcataataaagcccgtatttttcaccgcacttttaatataaatttgataaaaaatatcatattgctgttgatctgtatcctgaaactcatcaatcatagcaaaaggatattgatggcgaataagttgtgctaatttatctccttgtggttgatataaagcattgcgtaccagacgtaaaagatcatcaaaccccttttgttgatgcgtaagtttataatccattattttacgatttaattcatgaacacaatggtataaaagtacagaaaaattatttgaaatttgagtaacttcattggtcactaagttttccaattcggaaaataaatcatgcgatactaaaggttcttttttatctaattccaattgataaaaatattttgccgcctcaggttgctgaatatcctcgttttctgcccatactcgcattttattaaaacgactttcaaaccaatctttacgccatttttttaaagcgacaagctctcttaacgctttttcattttctaaccaacgttgtttaaattgatgaattttactaagttgaggctcaacttgagtatgtaaaaattgctgcagagaaatctccaataagtgcggtttttgggtatttacttttggcggctgagaaagatatttataaacgtaagataccagttgcctcggcgatcctaattttttgaaaatgaagtttgcgactgacaaaggctgatgataaaaattttcacgccatagctcatttgccaaacgttgaattagttcagattcatcactcaccagttccatattaaaatgtacccccgaattaaaggcatattgcattaatactcggcgacaaaaactatgaatagtcgaaacggcggaaatatccaaatttcgttctgctaaagttaaacgatagactgcaagatcgatgtctttaatataaggcagtaattcttgcagaaattgatcttcaagtaatgttttattttgatgttgctgatattgaattaacgcttgttttgtttgataaatacgttcccgaatacgttgctttaactcttgtgttgccatttctgtataagttactaccaaaatttgatcaacttccaatgcctgagaaaaattattttctcccgcttgtaataacaagcgaatataaagagaaacgatggaatgagtttttcctgtaccggcagatgcctcaattaaactgaccgcacttaacggagtagaaataggattaaaaggttgaaagacggatatgtgtaaggaagaatattgatcttgtaagctggtcatgaaattaagcatcttcgatagaacatagaatattgactaatttacctaacctaaactctttttgcaaaccttcaaaccgatgtaaaaataaaacggagcagatcttccgctccgttctcatgttatttgccattcaaactatctaaattacgtaatgcttcaatacgtttttccaatggaggatgacttaagaataaagaagcaagtcctccacgttttccattgatggcaaaagcagctagctgcccctccatttcttgtggctcatgcaatgttttcaaacgttgtaacgctgcaatcattttatgtttacccactaattccgctgaacctgcatcagctttaaattcacgatagcgagaaaaccacattgcaatcatacttgccaatacaccaaacacaagctcaagaaccattgaaatcataaaatatataccttgactggtatttccatcacgatctgtagcaacaacttttgccagcattcgagaaataaaaatgacgaacgtatttaatacaccttgcaacaaagtcatcgttaccatatcaccgcttttaatatggcttacttcgtgagctaaaaccgcttccgcctcatctcttgtcatagcatttagtaatcctgtactcacggcaacaagtgaattcttttttgtcgcacctgttgcaaaggcatttacatccgctgaatgataaatggcaactgtcggcataggtaatcctgctctttctgcctgtgaatgcaccgtttgaagcaaccaatgttccgtttcattacgaggttgttcaataacttgaccatttaccgaacgtaatgccattgattttgacatcagtaaagaaataatagatcccgtaaaaccaaataaagtagcaaaaatcaacaatcccaccgcatcttggcgttgaataccggtcaacgtcaaaataatgttaaaaacaaataaaacggcaaagttagttgctaaaaatagcaaaattctcatcataataaagttcctttacattaaaaattctctgcctatgataaggacaaaatattgaaactcaagggtaaaataaaaaaatttgttaccataaactcatttgtttttgctcaattattgtgggaatactgacatataatccaactaaacgcacagaacgattttgatgtcgttgccaaatttgagttaatagttttacaaaattttcttgcgaacatttcaccgcacttttttctaatgttgttatttggaagtcataaaattttaatttcacgcctattttacaaaaacgttctaagggaatagcaggacaagtctttttaattcgtttcaataaaagaggataaaggctattgataacctcaataccttgttcaacctgcaaaatatttttcattaaagttcgttccagcccgatagatttaggttcacgatgagactgcacagggcgttcatctataccttgactaaattgccaaatacgatgtcctattttaccaaatcgatcgattaaaacatgatagtcaaattgttgaatatccgaacaagtttccaatcccatttgctgtaatcgttgcgttgtcacttttcccactcccggaatttttttcagtggaagttgcctaataaacattgcaacttcttcaggtttaataacaaactgtccattgggcttattctgatctgaagcaattttagccaaaaattttaacggagcaatgccggcagatgccgttaatcccgtttcctgagtaatgatttgtctaatttcttctgcaatccacgttgctgagcctgaacatttttgacaatccgttacatccaaataagcctcatctaaagataaaggttcaattaaatccgtataacgcaaaaaaatgtgttggatttgttgcgaaacctgcttatataaaggcatatttacagctaataataccaaatcgggacaaagtttcagtgcttgcgatgttggcattgcactatgtaagccaaactgacgagcaacataattacaagtacttaataccccacgctgattagccaatccgcccacagcaacaggtctatcatacaattccggtttatctcttatttcaatagatgcataaaagcaatccatatcaatatgaataattttacgaggcatcattgttaaaagtgcgattaaaatgttcaaagttgaccgtattctaacatttttactgtataaataaacagtttttgttgtttttcttatttaacatcatttatacctatttttctccaagtaatgtcttttagctatgcttttttgaaagctgtacattttattctccttctttccgatacggtcctaccagctaaaatttttgataaaatcactgatttttttgcaaaaaaggcatagaatacaggacgcatttgcaccttaatagaaatgttattaaaatgcggtgttattttgtgctaaaccatttttaggaaaatcagatgagccaagaatttttggattttgaactgcctatcgccgaattagaagcgaaaattgaggctttacgttcagtttcacaacaagatcaacagattaatttagatgatgaaattactcgtttacaaaagaaaagtgcggagctaacgcaaaaaacttttgctaatttagatgcttggcaggtatctcaaatggctcgccaccctaatcgtccttatactttagactatattgaacatatttttacagattttcaaacactggcaggcgatcgtgcttttgctgatgatcaagcaattgtcggtggattggctcgtctagaggaacgtcccgttatgattatcggtcatcaaaaaggacgtagcattaaagaaaaagtaaaacgtaactttggtatgcccgcacctgaaggttatcgcaaagcattacgtttaatgcaaatggcggaacgatttaacttgccaatcattactttcatcgacacgccgggggcttatccgggggtcggtgcagaagaaagaggtcaatctgaagctattgcacgtaatttacgtgaaatgtctatgttaaaagtaccgattatttgtacagtaattggtgagggcggctcgggaggtgcgcttgctatcggtgttggtgataaaatcaatatgctgcaatacagtacttactccgttatttctccggaaggctgtgcctcgattttatggaaaagtgcagcaaaagcctctacagcagcagaagtaatgggcttaacagcttctcgtttgcacgaattaaaactgattgatagcataattgaagaacccttaggaggtgcacatcgcaactatgacactatgtcaaataatctgaaaaaacgtttgttagccgatcttgccgacttggataaattagatcaagagactttattagatcgccgttacaaacgattaatgagctatggttattgctaattttataaaaatagggcggtcttataccgctcttttctatttatagatatgttatagaggaagaaaaaatgaaaaatattctctcaattcaatctcacgttgtttatggctatgcaggtaataaatcagcaacatttccgatgcagttgctaggcattgatgtttgggcgttaaatacagtgcaattttctaaccatacacaatatggaaaatggaccggcatggtcattcccaaagaacaaattggtgaaattgtacaaggtattgataatattggagaacttcatcaatgtgatgctgtcctgtccggttatatcggctcagcggaacaagtagaagaaattataaaagcctttcataaaataaaagaacgtaatccaaaagcaatttatttgtgcgatccggtgatgggacatcctgataaaggctgtgttgttgcagatggtgttaaagaaggactgattaaaattgcgatggctcaggcagatattattaccccaaatttagttgaactaagagaattaagcggattagcggttgaaaattttgaacaggctattgaagcagtaaaagtgattctaagtaaaggtccgaaaaaagtattggttaaacatttaagtcgtgttggtaagaatgctgcacaatttgaaatgttattggcaaataatgatggtatttggcatatcagtcgcccattacataatttcaataaagaacctgttggcgtaggtgatttaaccgccggattattccttgcaaacctactgaatggaaaatcggatgttgaagcatttgaacatactgcaaatacagtaaatgacgtaatggaaacaacacataatgcaggcgtctatgaacttcaaactattgctgctcgtgaatggattgttaatccgaaaagccaatataaagcagtaaaaataggttaatcttattaaattgtaggggttatcactcctacttttaatatttccaagttcaatagatttcgatcggaatccctatggatttattacaacagttacaaaatcagttaaatcagtttccctctcatactaaacttctactaggatttagtggcggactggactcaacggttttgttatctttattggcaaaactcagaaaaaaacaaccgcacttatccttacgggcaatccatattcatcacggattaagtcaaaatgcagataactgggctattcattgccgacaaatttgtcagcaactggatatttcttttctgtgtgaaaaggtgacgattaatcctcgtaaagggattgaggctgatgctcgtgaagcccgttatcaagcgattgctaatcatctacaagacaacgaaattcttgttaccgctcatcatcaacaagatcaaacagaaacctttttgttagctttaaaacgtggcagtggcttacagggattgggggcaatgcaaatacagagtgttgtttttaatctgcctatttttcgcccgcttttacattgcacaaaacaacaacttgagcaatatgctaaaacagaaaaacttagctggattgaagatgaaagtaatgctgataatcgttatgaacgtaactttttacgtaatgatattttgcctaaacttcgtcagcgttggcaatctattgataatgcggtacaacgtagtgctcaacattgctttgaacagcagcaactgattaatgaattgcttaatgatgaatttaataaaatttacgataaattcgaccgcactttatccattgccaatttcgctacttactcaattttaaagcaaaaagccttactacgaacttggttacaacatctccatattttgatgccttcaacaatacagttggataatattatgagaaatatgattcaagcacaagaggatcgtaatccgacatgtagacttggaaatcaggtcttacgccgttatcaaaaacgtctttatgctacgccgatattacaagatttaagtcatattcgcctagatattcaagctaacgaatgcattaatttaccggataatttaggtgaaatttgtttactaaccaaaaatgagcatttgcaggttacatggcaaaataaacagattttattacccctgacacaggaaaaaatagaaattcgctttcgctattccggtaaagttaaactcccacaaggatttcatcaagaaatgaaaaaatgctggcaagatcataatgttcctgtatggcaacgcacccgtattcccttgattttttatggcaataaatttaaaagtgcggtaggtttttttaataattgtgagtaaaaaaataaccccatcttgatggggctattttaagaaccaatcctatcttaacgccaacttttaaactgattaattaaaccattagttgaactgtcgtgactattgatttgctcatctccaaccagttctggcaaaatgcggttagcaagttgtttacctaattcaactccccattgatcaaaactgtaaatattaaaaatcaccccttgtacaaaaattttatgttcgtacatagcaattaatgcacctaacgtgaatggtgtaattttttgcactaaaatgctgtttgtcggtttattaccggtaaaaattttaaacggtacaatatttttcacttcatctaaggacttcccagcttgaataaattcagcttcaacttcttgttgtgttttaccaaaagcgagtgcttctgtttgtgcaaagaaatttgaaagcaatttattatgatgatctgataacacattatgggtttgtgctggggcaataaaatcacaaggaataatcttcgtcccttgatgaattaattgatagaatgcgtgctgaccgttagtgccaggttctccccaaataataggaccggtttgataattattaatcacttgaccactgcgatctacatatttaccgttagattccatattaccctgttggaaataagctgcaaaacgatgtaaatattggtcataaggtaacatcgcttcagtttcagcacctaagaaattacagttccaaataccaattaacgctaacgtaatcggaatattttgttccattggtgcggtgcggaaatgtttatccatttcatgtgcaccagctaatagttgctcaaaattgtcaaacccaatagaaagtgcaatagaaagtccgattgcagaccataaagaataacgaccgcctacccaatcccaaaattcaaacatattgtgagtatctataccaaacttctccacttcttttacattggttgaaagtgcagcgaaatgcttagctatttggctttcatcttgtgcggctgctaaaaaccatttacgtgcagaaatcgcattagtcatagtttcctgtgttgtgaaagtttttgaagcaactaaaaataaggttgtttccggatttacttttttcaacgtctccgctatatgcgttccatcaacattggaaacaaagtgcatggttaaatgatttttatagggacgtaatgcttccgttaccatataagggcctaaatccgagccgccaataccgatattcaccacatcggtaatcgctttaccggtgtaacctttccaatcaccagaaataacacgttgacaaaaagatttcattttcgccaacactgcatttacttccggcataacatctttaccatctacataaaccggtgtatttgcacaattacgaagtgcggtatgtaatacagcacgattttctgtacgattaattttttcaccattaaacattgattcagttgcttcattcaaagcacattctttagctaactgacgtaataaagataatgtttgttgattaatattattttttgaataatccactaaaatttgttcggcaaattttaacgaatagtcattaaatcgagtcggttcttgctcaaaaagttgttgaatagtaacttgctctaagtctttttgatgttgctctaaagctttccacgcattagtttgagttggattaatattttgcatcatttttcctctctatggtttaaaaagttaatcaatatattcgatcaatactctaggtgttaatttagtgataagttcatagcttatcataccgctaattgcagaaatttcctcaataggtaattcctttccccataaaataacttcatcacccaccttatcttgactctcaataccaagatctaccgttaacatatccatcgatacacgcccaacaattggtacttttctgccattaatatagaccggtgtaccttgaggcatatcccgtggataaccatctccatacccaatagctacaacgcctattttggtatctctctcactaatccaacttccaccataccccacaggttcaccttttttatgatttctaatagtaattaatgaagaagttaacgtcataaccggaatcaatccataaacctcagcaggcgtattattcggcgagataccatacataataatacctggacgaatccaatctaaataggcttgctgccaaaacaaaatacctgatgaggcaacaatagatcgctcaccttgtttaccctcggtaacttgtaaaaaacgctctaactgaatttccgtataaccacacatcaattcatctgcccgactaaaatgactcaaaaacccgatttcttttacatttgaacattgaacaagttgctgataaaagtcttctacctgttcaagatctacacctaaacgatgcattcctgtgtcaattttcaaccatactttaattttattcggcaacttggctttcttaagcacataaagctgttcttgattatggataactgtttgaatgttattaacagcaataattggcaaatcatcctcggaaaaaaaaccctctaataataaaataggtttagtaataccttcagtgcatagacgtaatgcttccgataatctagccacaccaaaacagtcaaccagatgatgcagagtagaggaaacgaactccaaaccatgtccataagcatttgccttaacaattgcaatgactttactgtttttggctttttgcttaataacttgaatattatgttttaatgcaacagaactaatcctggctgttggaggtatgacattcattgattcgactctaatcttattttgtataatactgcggtatatttgctaaattatcaaaacgtgaatattgcccctgaaaggctaatttcactgttccaataggtccattacgttgcttaccgataataatttccgcaatgcccttattatcttccgttgtttcgttataaacttcatctcgataaataaacataatcaaatccgcatcttgttcaatggatcccgattcacgcaaatccgagtttataggtcgcctatcccctctgttctccaatgtacgatttaactgagaaagtgcaaccacaggaacttttaattctttcgctaatgcttttaaggaacgagaaatttctgcaatttctaaagtgcggttattttcaaatcctggagctcgcattaattgcaaatagtcaaccatgattaaacttaacccgccattttctcgatacactcgtcttgctctggagcgtaattccgttggcgttaatcccgaagaatcatcaatatacaagttaggtttttgcttaaacatcccaaaggttccggaaattttagcaaaatcttgctgtgttaaattacctgtacggattttaacctgatccactcgagaaagtgaggctaacatacgcatcaaaatctgttcagccggcatctccaagctaaaaaccaaaaccggtttttccgataacatcgcagcattctcacataaattcatagcaaatgttgtcttacccatcgaaggacgagctgcaacaataattaaatcggatttctgtaatccagatgttttttgatccaatgcagtaaaaccggttgaaacaccggtcacaccgttatttgttggtgtagccgccagattttcaattttatcaatagtgttaaaaagaagatttattacattttgcggtccttcattagctgatgttcgtttttccgcaatagaaaatatatcacgctccgcattatccaaaatgtcttttattgcttgcccatttggtttatacgcattttttacaatattatttcccactgaaattaactcacgtaaaattgctttttcacgcacaatttcagcataagtcaaaatattggccgcactcggcgtattgttggacaactctgctaaataagcaaaaccaccgacctcttcactttttccttttgtctttaacacctcatcaagaactaataaatcaacaggggtattttgtgcaaataataatgcaatttcttgaaaaataatccgatgttcaaaagtataaaaatcttcggcaatgatctgatccgctacgctatcccaataacgattatctaatagaatcccacctaaaacagcttgctccgcttcaatggaatgaggaggaatgagggtttgctcaaattttttatctttgatccgtgcagattgatttgaaccggtagttgctttagtcattaaaagaaaaattacctaattagaaattgaaaactgtgctatatgatataccaaatctaagcgagaattaagagagagggaaaaattaatcaaaacaatataagtgatgaaaagcaaccgcaccttaaagtgcggttatttttgagaaattttacttcttacgtcgttcaattaatgcctcagacaattgttgtaatacaatttctgtatctgaccaaccaatacaagcatcggtaatactttgtccataggtaagtgcttttgcttcaactaaatcttgacgaccttcaactaaatggctttcaaccatgacaccaaaaatttgttttgaaccattggcaatttgagtacaaacatcagtgcaaacatctaactgttttttaaattgtttactactgttcgcatgactaaaatccaccataacatgcggaatgcgaccggttttttctatatccgcacaaactgtccgaacatcttccgcactataattaggacctttctcacctccacgcaaaataatatgacaatcctcatttccttttgtagacacaattgctgaatgaccgaattttgtgacagatagaaaataatgtggtgcttctgccgtacctattgcatcaagagcaatgcgaactccaccgttagttccattcttaaagcccaccgcacatgacaaaccggatgccaattcacgatgaacttgcgattccgttgttcttgctccaatagccccccaactcataaagtccgcaaggtattgcggtgaaatcatatctaaaaattcaccggcagtaggcatttccatatcgttaatatcagataacaatttacgtgcaatacgcaaaccatcatttaaagcataactaccatctaaatgaggatcattcactaatcctttccaacccacagttgtacgtggtttttcaaaatacacacgcattataatttccaacgtatcatgatattttatacgcatttctttaatgcgtttagcatattccaacgcagaagcaggatcatgaatagaacaaggtccaataataacgagtaaacgatcatctttttgatgaataatgttatgtgctgccaagcgggctttttttactgttttaatggctacatcacttgcaggaaatttttctaataatgcaatcgggggcaaaacttgctcaacttttgcaattctggtgtcatcatttgcaatacgaatattatttttattcttagccatatactactctctcttactacataaaatttacaatcatagaattaacaatttatatttaatggtattaaacgtaacatttatttttgtactagtaaactaatttctcctagtacgcacttaagacttgtgcaggttgtaatttagccgctcggcttgctggatataaacttgccaataaactcaacatcaaagcgaccactagtaccataagtacatcttgccaatgtaattcgctcggtaaaaaatcaataaaataaattccatctgataataactttttatccagtaaaaattcaataaattgaatcagatcggttaaatttaaactcagtattacccccaatgctattccaactaaacagcctttcatacctgattgcaacccgtaccaaacaaaaatttgtttaataaaacgattattagcccccaatgtacgcataatagcaatatcagcctgtttatcttttactgccataatcaaagttgacacaatattaaaacaggcaacacctatcaccaacaccatcgcaatatacattactgttctaattaactgaatatcgttatacatataaccaaacttgccaatccaatcttgaacttgtaggcgttgcggataatcatataaatattcatacgtcatatttctaaccgcaaaaggatcttgaacttttagctcaaccccagtaatttcatcgggcgtataatccaataatacttgtgcttgcgataagctcatcaacgcataactatgatccaattgcccatctaaacgcaaaatacctgttacttgaatgcgataacggagaggctgagataattgattatcgctattagcaaaagaaattaataacgttacccaatcattttcggatacacctaattctttcgcaatgccatagcctaaaaccaaaccgccatttttctgaaattgttgccagccatcatttaacacaaatttactcaaattactcacttgatcttgtgtaacttgttctattcccctcacttgagctactttcagttttgtgccgttttcaattaatgccgtaaattcaacaaaaggggattgtgctaaaacatttggatcctgctgtaaaagtgcggtaattttttgtcgactttcaatcttgacatttccttgctcttgatacgatataatttcactatgtggaacaacagataaaatacgctgattaagttctcgctcaaaaccgttcatcgcacttaatcctacaatcaacactgccacacctaatgcaattccaatagttgaaaataaagcaattaatgataccaacttatttttagaacgactgtattgataacgccagctaataaaaaatggagtattcatgagttactttccctcaagataccgtcttgcatcactaaacggcgacccaacttttccgctaattgcaaatcatgagttactaataaaaatgcaattttttgttcctgattaagtttttggataagttcaaaaatactttctgttgtcttatgatccaaatttcccgtaggttcatcagccaacacgagttttggattattcaccaacgatctagcaattgcaacacgttgacgctctccgccagaaagtgcggacggtttatgcaaaattctcttagccaatcccaccgcactgagtatattctcagctcgatctttcgcctctgttttatttttgtgactaattaacatcggcatcatcacattttcaagtgcggtaaaatccgccattaaatgatgaaattgatacacaaatcctaaatactgattacgcagtttagctaattcgtcctgtgttgccctttgtagtgatcgcccatgaataaaaacttcaccgcttgttggctgatctaatccgcctaacatatgtaaaagagtacttttgccggatccggaacttcctacaatagcaattaattctccttcctgcatggaaaaagacacctcttttaagacttgagtttgaagacttccttcctgataatgctttgtaatattttgacagattaataatctattcatcgtttgctccagttctcttattattcataacgtaatgcttgtgctggctcaattttactcgctcggtaagccggataaattgttgatattaaagataatgttaacgagaaaaataaaattaacgcaatttgataaacattaatttctgtcggtaaaaaaataccctgaggattaatccactgaataatcttcgctaaattcattgctacaacaacccctaaaccgccacctaacacagcaccgcttgcccctacaaaaaaaccttgcaaaataaaaatattacgcacttgtccttttctcaatccctgtgtttgtaaaatagcaatttcaccttgtttatccaccaccatcaaacttaatgaagtaacaatattagaaaccgccaccacaataattaaactaattagcaagctcatcatattcttttccatgcgaactgcttggaaaaactcccctttttgactacgccaatctacaattttccattgctcagtagggaaaaacttaggcaattcactaatgaaaaaaggatcttgcaaaaataagcgataaccttgaacttgttcaggtttgatccgcattaagcgtccaatatccgctaaattggcaaaaactgcatagcttgcctgttcagaaaaggaagagtaaatatcactgatggtaaataaacgttgtaccggaactcgaccaaagggagtatattggctattttccgtcaccatcactcgaactttatcaccaatctgtacgtttaatttttgtgccaatttccaaccgataattaatttaaactcaccgattggaagaagttgcgaaaaatgattttctgaaaactcactcaataaaggatcatcagaaaatttttgcaccccaagaatttgcccggcactgacaccttgtgcagtttgaaacacgacagaagttgtattaatcggcacaactttttgcacaaaatcgggcatgtccggttgcgaggcgatcaaatatatagaattatttttaggcattaaaatactgtgcggaatattggaaagaacctgttgtttttgatatttttccaagccgttcatcacagacaaaacaataattaacgccataacacctaaaataataccaacggtagcaagcgtcgtaactaattgcccgaagtgatccgcacttttagcccgccaatagcgtaatgcaataaaaagagaaattggaaaggtcatcttataatctataaaattacaaatctatgaattcacgttgcgactacatcaagaaaataaaaacaataaaattggacttattaaaccagtgttttctttgttactgaaaatcaatctaacaaacccaatttagtcatttttactgagtaaataaaatcagcttaactaattatttacctgttttgacaaactcttcaatattttgtgcaactttgttcaccaaagtggtcaccgcactatctgatgcccatgcaatatgtggagtaacaatcaagtttggtaaacgagtagctgcctgaataagcggattctctttctcaggcggctctttaaccagtacatcaatagccgctgcggcaatcactttattttccaatgcttcaaccagtgcctgttcatcaactaaagggcctcgtccggtattaattaagtaagccgtcggtttcattaactttaacgtttctgcattaatcaaattttgtgtttgctccgttaaaggacaatgcaaagtcacaatatccgcttgctttaaaacctgttcaaaaggtaaatatcccgaacgaatttccgttgcaccacaacgttcagcgtaaatcacattcataccaagtgcggtcgctaatcgaccaatttccgaacctaaacagcctttacctatcacgcctaaagttgatcctttaacatcggtaatcggataatcaaaatagcaaaattgtttacagtctgcccattttgcacttaactgatctttgtaccaattcattaaactatgttttaaggcaaaaattaaacctaagacatgctcaggtacggttaccgaagaatagccggttacattttttactgtaatacccaattctttagctgctattaaatcaacattattcgttcccgttgccgtaatagcgattaattttaacttaggtaattgcaacatcacctcacgactgaaaataaccttactggtaataacaatatcagcctcttttgcacgatctatcaactgatcagcatcggtatattcatattcaatccattgatgctcaaaacttgggcgaggaatagtaatatgttttggaattgccgtactgtctaaaaatacaatttgcatcattttctccttagttaattggaataggccgtgtcaatataccaaagtaataaacataaatatagaaaaaatccgtattcactaaaaatacggatttttcattatgctcatttaatttgaagtatctatttcctcaaaagatttaactagatcatcaatagctttcatttgtgcaacaaaaggttcaagttttgataaaggtaatgccgatggtccatcacactttgcttggtttggattaggatgagattctaagaataatccggctaatccaatcgccataccggaacgagccaattcggttacctgatcacgacgaccaccggaagctgccccaaaaggatcacgacattgtaaagaatgagttacgtcaaaaataacagggcaaccttgcgacacttttttcataatattgaaaccgagcatgtccaccactaagttgtcataaccaaaattagtacctcgatcacacaaaatcaccttattatttccacattctgcgattttttccacaatattgcctatttgacctgggcttaaaaattgtggttttttcacattaatcaccgcacctgtacgagccatcgcctcaactaaatcagtttgacgagctaaaaaagccggtagttgaataatatcaacgacttccgctacaggtcggcattgataaatttcatgtacatcagtaatcacttttacaccaaaagtctcttttaattcttggaaaatttttaatccttcttccattcccggaccacgataagaatgaatagaagatcgattagctttgtcaaatgaggctttaaatatatagggtacgcctaatttttgcgtaacttctacatatttttcacaaacttgcatcgccatatcacgactttccaacacattcataccaccgaataaaacaaaaggcttattattgccgatttcaatattgcctaactgaataacttgattttgcataatcatttccttactaatgaatagattcaatttctaattgtaaatattccaattgaggtaataataaaagtgcggtcggatcttccggacatttttctaaaaaatattcaaagtcattcaatgccgcttgcatacaccccatttgagttaataccaccccacgatcacgaatttcataaggatcatcaggatttctggacaagagcatatcaatatattgatatgcctcattatttctaaattcacgaattaacgcatgctttgctaattgacaaaaccgattcgttaattcttgcacatctgcaacttctaatatctccaagcttaattcagtaccaaaaccaaatgctccttcatataacttttttagctgagaatatgtcatatattgaccattccaaggatcaataaaggcaacctcttcatcaacatcagcacgcaaaattaattgcgtaggaaaattgaccggataaatgggcaaattcaacctttcagccaagtataaaactattgctcccagtgttaccggcattcctcttcgttgcgttaacacttgatccaaatataaattctccaacgcaaaataccgttcgggatcacaaaaaaatccccattctccatacatcaactgcaataaatgatgaatttttcttttagtttcccaattagaatcaatttttttacgagcttcacgaaccaaaccgccaatcatgcctcgaatacgccgtatttctttactactattgtcatgcgtaataagataaaaagaggtcatttcatcatataatgctttatgataatacttcattttttcctcttaattgagctaatgttattcgctcattaccgccataatcgttaatcgtttcaacttgtttccacagtttctcggcaaaaaaagaccgcactttttgcccttgctgccagccatgctctactaataaaaaaccttgtttttttaaataattaggagcttgctcaataatatattgtaaatcggcatatccttttttttctgccaccaacgccgtcaaaggctcaaaacgtacatcaccctgatttaaatgctgatcttccgcatcaatataagggggattactgacaattaaatcaaattgtccagttacttgctcaaaccaattactttgcaaaaactgtacttcggtcaaatgattacgcactgcattagtttttgctaatttaacagcgtcggcaataacatccagaccaaatatctcaaaatgttgaccgctctttttcagttcatcagccaacgccaaagctatagcacctgtccctgttcctaaatctaaaatacgaatgggggattgagtaaagtcttttgatttcttaagcaattgaatgcaaaccagtgcttgttcaaccaaaatctcagtatctggacgtggaattaaagtatagggagccacctgtaaatttaatgtccaaaattccgtttcacccagcacatacgccattggttcacctttagcacggcgaaccaataattctgtgagttgtttcaattcatcctctgtcaataaggtttctgaaaaagctaaaatcgctgattttgaacgtttggtgacggtttgcaataacaaatttgcatcaactttagcatctaagaaaggatctttagcaacattctcaaataaacgtttttcggcaagttccagccattgttgataattcatttctttagtgaaacttaagttttcttcacaacgatagtcgacataactatatccactaacgaacgtctttccttatttgcaaaagcaacaattgcactaactgaagttaagatacctgttaatgcaaaaagctgttcaataaattcacgcaatacataacgaccaaatgttaaggggtgatttgttctatagtctatcacttgtaaatttagccatttctttgctaatgtttgcttagcattatacatgaggaataattgatatccgatatagaggaaaataaaaatgagacctgcaatctggttcaaaacaatagatccaaacaaaatagccacatagaacaacaatacatttatgagggaagccaaccaacgcttaaatcgactggcataaacaatatctgatacgttattagaatttgcttgtaatttatgatcttcttcaacaataaatttacgattttcatcattagaattgtttttttcatttaatttttcaacaatcattgtatctccttctcataatcttaagaggaattttttcttcgtcaaaatagattaattttgttcggacaacattgccaactgatctgcttgatattccgtaataattggttgaattagctcgtcaatcttgccattcatcacttcatcaaggcgatataccgttaaattgatacgatgatccgttacacgaccttgcgggtaattgtaagtacgaattttatctgatcgatcgcctgaacctaataaattacgacgagtatccgcttgggcttgagcttgacgttcctgttcagcttgtgcaatacgagaagctaaaacggaaagtgccttcgccttatttttatgttgtgaacgctcatcttgacattccactacaatacccgtcggaatatgcgtaatacgcaccgcagaatccgttgtattaacatgctgaccaccagctcccgaagagcggtaggtatcaatacgcaaatccgacggattaatctccggcatttcattttccggtaattcaggcataacagctacggtacacgcagacgtatgaattctgccctgagattctgtttttggtacacgttgcacacgatgcccaccggactcaaacttcagttgaccatacacgccttcgccattcactttgacaataatttctttatatccgccttgctcactttcatttgcattcaatacttccacacgccaacgtttactttctgcataacgactgtacatgcgaaataaatcaccggcaaaaataccagcttcatcaccgccagttccagcacgaatttctaaataagcattgtattcatcatttggatctttaggtaataacaggatttgtaattgttgctccgcattttcaatttcagcttttgactcttctatttccaattcagccatttctttcatatcaggatcatcaagcaatagttgtgtttcttcaatattgttattcaaccaattccaacgtgcaaaacattttacaacatcttctaattgagcatattcttttgaataagcacggaatttatcttgatcgttaatgacagaagactccccaagcaacgcttcaagttcttcatgtctctcttttaagctctctaatttactaataatactggctttcattctctgaccttacaaaataataatgtaaatttaaatttcaaaacttaatatcaccgaaccattggtatattttatcgtgtattcgagtaccataaaaatcaacaatatttctatcatatttgaaaacagcggtggaaaataaggtaatcactctttcaaaattcacatcaagcaattcaaatagttcactcggcacaacatcttgatatacaaatacattctcaaaatacttttgataatctgttgtttctctagggtgtggttttatcactagcaaacgctcgtcataattttttatgatatgttgataaatggctattttctcttgttctgatattacacgatcttctgataaacactgcgtaaataatatatatttcttcatttttaacgatataagtgaatctaaattaaaagcaaagaaatccaatatgttatgttgttcttgagctgttcttgttttccataaatgctctaatgaaatcagttcaactttatgcctaatgtcacttggtacattttctaaagaggtcaaataaattttctttaccgtcttatgaaaaccaaaaacaggaatattccttgttaaattaatttcatatcttttaggactaaaattcgctatgccatcctcgattaaataaaaatcaaaatatttaagaaaataatctgtccaacctaaatgatcagcaccataaacaggaatacggtcaatcttaaatcgataaaaataaagtttataatagagacgccaaaattttgttattttctttttaatggcaacatagtgcttgattttatactttttatgtaattcaaaaccttcattaaaaacaaataacacttcatctaaatgatatttatttaacatcagaaaaatcaacaacattcttaaactactgacaataacaattgctttgatttttatattatacttcatgatattcaactattttggctctaaatcttagattattacccaactccgaaaacagaaaattcaattcgaggctgccttagaattacctaaaacagcctctatataataaccataatagcagagctacattacagaaacatttaaagtggagccaccaacaatacgaactcgagctcccggcactaaagttgcatcatacttttgcacaacaacaatttcttgtccattgtcttttctgataacaagttccaacgcattaatctgacttgctttttcttctactttactaccaattaccgctccggcaatagcaccaactgctgcagcgactgcctgtccggtaccaccgcctataccagatcccactattccacctaaagcaccaccaccaacagtcccaatcacaccttggttatcgccttgaattttaaccggacggattgattcgatgataccataactgattgaacgagctgatttagcttgtgtgccactatatacattaccactgtatatatcttcattggcacacccagctaatcccaaactaagtaaaatagctaatgataaagtcatttttttcataatagttaacctctcttttttgattaatttttagatgttctagaaagccaagaacttgatcttttacgagaaatatttgttactgttataccatcgtcattgtgagacacctctacacaagagcctacaactaaatgagaatcgtaagaatgacttaatacgatctccttaattcctccctcttgctgtttgcaatcatttttacgaatagttaattttaaattatttcctttttgagcagcgaacaaaatttcgcccttatacacattatcattttttgtagatgagcaagctgctaatcctaaaaaacctaataataaagtgaatgctaatgttacttttttcatcgaatctaaccctcaattatctttttgatatgatacgggtgaacttttatgcaagtatgattttctagttgattaacaaaactcactgcaatagacgggttaggtaattgctcgccatccgccttaggttcacttactttaactttcaaattagccaattcgtcccataaaaattgttgtcttatacgtgtaacccattcatcaacagtttcattcacttcaaatggaattacaacttcaatatgctcccagttttccactggatacactttatctttagggaacggtaattcaataatatcaataaactgatccgaaaaacgtatcggattatcaagttgaattaaataaataactctcccgtttacaatattaccgctcagaattgtaccgcactttaacagcaaagtcagccaatcctccgcagatttacgtttatttactctcaaggcaatatgatcaatttcaacacgatctaaccgtaattgcatgaaatgggctaattcaataatttttctttcaaattgttcaaactcatctaatgagatattagattgccgaaacaaagaatgattttggttaaaaatctgcattttttattgctttatcttttctgaataaggaaagagcggtatcataacgcattattttcacaaatcaattattaggtatatcagtgaatattcagtctattttatctaacaaaatcaaacaagcgatgcgtcaagccggtgcagatgaacaatgtgatgctttagtgaaaccatccagtaaacctcagtttggcgattatcaagctaatggaattatggcaacagctaaaaaactgggtttaaatccccgtgattttgctcaaaaagtactcgatctcattgatttaaaaaatattgccgaaaaaatggaaattgcaggccccggatttattaatatcttcttagataaaaattggctggcagaaaatattcaagttaccctacaggataagaaattaggcgttacagtcgaagaaattcaaaccatcgttgtagattattcctcaccgaatgtagcaaaagaaatgcacgttggacatttgcgttcaaccattattggcgatgctgtagttcgtacattggaatttttagggcataacgttattcgagcgaaccatgttggtgactggggtacacaattcggtatgcttattgcctatttggaaaaaatggaaaatgaacatgcttcagcaatggaactggcagatttggaagccttctatcgtgctgctaaagaacattatgataatgatgaaacctttgcagaaaaagcacgcaattatgtcgtaaaactacaaaatggtgatgcttattgtcgcacaatgtggaagaaacttgttgatattactatgcaacaaaatcaacgtaattatgatcgcttgaatgtgaccttaacccaaaatgatgtaatgggggaaagtctgtataatccaatgctacctgaaatagttgcagatctaaaagcacaaggtttagccgttgaagatgaaggtgcacaagttgtttacctcgaagaatttaaaaataaagatggtgatccgatgggggttatcgtgcagaaaaaagatggcggtttcctctacacaacaacagatattgcagcggctaaatatcgttatcatacattaaaagcagatcgtgctttggtgttttccgacacacgtcaaagccaacatatgcaacaagcatggttgattactagaaaagccggttatgtgccggacagtttccagctggaacataaaaatttcggtatgatgctaggtaaagacggaaaaccgtttaaaactcgctccggtggaacggttaaactgacagatttattagatgaagcgattgaacgtgcggataaattaatttcagaaaaaagtaccgcactttcaagcaaagaaaaagcggctgtgatagaggctgtgggtatcggttcagtcaaatatgcggatctttctaaaaatcggacaaccgactatgtatttgattgggatatcatgttaagttttgaaggaaataccgcaccttatatgcaatatgcttatactcgtattcgttctattttcaacaaaaccgatattagcgaagaacaacttcaccctgcaaagatccagctcacagatgaaaaagagcgtttacttgcaattaaattgctacaatttgaagaaacagtacaaattgtaggcaaagaaggaacaccgcatattctatgtgcctacttgtatgagttagccggtttattctctagtttctacgagcattgccctatcttgaataatgataatgaaaacgtgaaattaagccgtttaaaactcgccttactcaccgaaaaaaccttaaaacaaggtttggatttactcggtataaaaacagtggaaaaaatgtagttcagatatttccattattggttagtataaaaaaggcaacatccgttgccttttctgtaggttattaatttactcatggtgtcaacaaagttcttaaaactttaccaatatcagccaaacttcttaccgttttcacgccggctttttccaaagcgacaattttttcctctgccgttccttttccgccactaataattgctcctgcatgtcccattcgtttgcctttcggagcggttactccggcaatataagccacaacaggtttagttacatgtttatggataaaatcggctgcttcttcctccgcacttccaccaatttcaccaatcatcactatcgcatcagtttcaggatctgcttggaataatttcaaaatatcaataaaactggaaccggggataggatctcctccaatccctacacaagtggattgtccaaacccttcatctgttgtttgttttactgcctcataagttaacgtgccggaacgagaaacaattccgatacgcccttttttatgaatatttcctggcataatccccattttgcattcctctggtgtaataacaccgggacaatttggaccaatcatcacgacatcactttgctgtaatttttttttcacctccaacatatccaacgttggaataccttctgtgatgcaaacaataaacttaatgcccccatcaattgcttctaaaatagcatctttacaaaaaggtgccggaacataaatcattgttgcggtagcaccagttttctccactgcctcacgaacagtattaaaaacaggcaatcctaaatgcaacgaaccactttttcccggggaaacccctccaactaattgagtgccataagctaaggcttgttcacaatgaaacgtgccttgtttaccagtaaaaccttgacaaatcactttggtatttttgttaattaaaattgccattattcactctcctttgctgcattaactgcttgttccgctgcttcagttaagctgtttacagcaattaaattcaagttactttgtgctaaaatttcacgtcctaagtccgcatttgttccttccaaacgcacaataactggaacactcacaccaatttcattgattgcggaaacaattcctttagcaattaaatcacaacgcacaataccgccaaaaatattcactaatacggctttaaccgcactgtccgttaaaataattttgaatgcttccataacccgttcttttgttgctccaccaccgacatcaaggaaatttgctggtcgtccgccatgtaatttaataatatccatcgttcccatggctaaaccggcaccattgaccatacaaccaatattcccatctaacgcaacgtaatttaaattccacttttcagcctcagcctcacgaggatcttcttgcgttaaatcacgcatagaaaacaagtcggggtgacgatacaacgcattatcatcaaccacaacttttgcatctaagcaaaataattcatcgttttttaaaataaccaatgggttgatttccagtagggataaatctttttcaacaaataatttggcaagttggcaaaaaatttggctgaattgctgaatttgtttccctgataatcctaatttaaatgccaattctcgcccttgatatggcatcgctccaaccaaaggatcgatagttaccctatgcaataagtgcggtgttttttctgctacttcttctatatccataccgccttcacttgatgccataaagacaatacgttgagagctacggtcaataattgcactcaagtacaattctttttgaatttccgcacagggttcaagataaatttgatgaatcggttgtccctgttcatttgtttgaacggtaactaaacgctgtcctaaaaacttagtaaaaaacgaccgcacttcttgtgctgatttaaccacttttactccaccagctttaccacgtccaccggcatggatttgacattttgcaatccattgagaacctgataatttctcaatcgcacttaacgcctgttcaacattttcacaaacataacctttagttacaggtaaaccataatctgcaaaaagttttttactctgatactcatgtaaattcatatcgtccccttattgatacgtttcaataccgcacttttagattatcggtacttctaaatttccagtagcaagcgagtcggatcttccagcaagtccttcactgtcaccaagaaaccgacgctttcacgtccatcgattaaacggtgatcatagcttagtgccaaatacatcattgggcgaataaccacttcaccattaaccgcaacgggacgatccttaatcgcatgcatacccaaaatcgcactttgtggcggatttataataggtgttgacattaaagaaccaaaaacgccaccgttagtaatagtaaaattcccccccgttaaatcttcaacggtcaattttccatcacgacctttttccgccaacaatttaatttctttttcaatatctgccatacttaatttatcgcaattacgtacaaccggcgttaccaaaccacgaggtgtggaaacagcaatactaatatcaaaataattgtggtaaacaatatcatcaccatcaatagatgcgttaatctccggatagcgttttagtgcttcaaccaccgctttgatataaaaagacataaatcctaagcgtgcaccatgttgtttctcaaatttttctgcataacgcttgcgtaaattcataatcggctgcatatccacttcattaaatgtcgtcagcattgcagtagtattttttgcttccagtaaacgctctgcgatacgcttacgtaaacgtgtcattggtacacgtttttcattgcgatgatcaattttcaacccagttacaatagactgagatgcttgtgccgtttctgtttgttgtgctttttgcttaaccactaacgctatatcttcacgagtaattcgaccacctacacctgtacctttaatttcatcagcatttaattcatgctccgctaacaaacgacgaacagccggactcagtacatcgctacttgcatcagtattcaaattagccgaatgacgatctgccggtgttttttccacattctgtacagttgattttgtaacttctccaatacctgccgaagcggatactttacccaacaattgtttactcacgacagttgaaccttccggttgtaaaatagtttcaagcaccccatcactaagtgcgggaatttccaacacaattttatcagtttcaatttccactaaaacttcatcacattttaccgcatcacccacgttcttatgccacgttacaacggttgcatccgccacagattcagggagatccggagtaataatatcgaaattgctcatattttttcctcctattcatatttcgcttaaaattagatatatatccgttaattattgaaaatttttccaatactttaacctagcaaaattacgctaatgcctcagttaccaaagctcgttgttgctcattatgtagagataaatagcccactgccggtgaagctgaagctggacgaccaacataacgcaacttaccatgtggcggtaacgacgtccaaaaattatgctgacaacaataccaagccccttgatttaacggttcttcttgacaccaaacataatcagtcacatgagaataaggtgctaaagcctctttcatttcttcatgtggatatggataaagttgctcaatacgaataatagcaacatccatttgattattttctcggcgttgttccaataaatcataataaacttttccggaacacatcacgacacgacgaactttttgaggatcaatcgcatcaatttccgcaatcacattttgatattttccatgtattaattcttccatagtagatactacaagcggacggcgtaacaatgattttggagtaataacaactaatggccgacgcactttacgcagcatttgacgacgtaataaatgataaatttgtgccggagtagaaggtacacatacttgcatgttttgctgtgcacagagttgcaaataacgctccaagcgagcagaagaatgttctggaccttgcccttcatatccatgtggcaacaacatcactaaaccacacatacgcccccatttttgctcgccggaactaataaattgatcgatcacaacttgtgcaacattcgcaaaatcaccaaattgtgcctcccaaatagttaatgtccgtggtgccgctgttgcgtaaccatattcataagctaaaacagcttcttctgataatacagaatcccaaacttcaaaacgcccttgttgagcatgtaattgagttaatggaatatacaacgtcgcatctttttgattgtgtaatactgaatggcgatgaaagaaagtaccacgtcccgcatcctcaccagataaacgaacattatatccctcatcaagcaaggtcgcataagccattgtttcagccataccccaatcaaataatttatcgccttgtgccattgataaacgatcatcgtaaagttttttcactcgaggatgtaatgaatgcgaacttggataatcacatactttcttagctaatccgacaaaacgctcagaatcaaaggagccatcatactcagtccattcttgcgttaaatacttagtccaatctttcgtttcaatatccgcttcacgccattccggtacaacacaacctccattatccaaagcatctcgatatttatttgctaattcaattgcatatgcttcatcaatgataccttcagtaactagacggttcgtataaactttcggaggtgttggatgcttacggatacgttcatacataagcggttgagtaacagcaggttcatctgcttcattatgcccatgtcgacgatatgacaccaaatcaataaaaatatcacgcttaaattttgctctaaattcaaccgccattcgtgcagcataagcaacagcttccggatcatcaccatttacatggataaccggtgcctcaatcatcttcgctatatcagtacaatattctgttgaacgtgtatcctgtagatttgaagtggtaaaaccaatttgattattaatcaccacacgaattgtcccaccaactgtatagcctctcacttctgacatattcagtgtctcttgaacaatgccctgccctgcaaccgcactatctccatgcaccgtaattggtaacacttgagaacgttcaacgtcctgaatacgattttgtcttgctcgcacagaacctaagacgacaggatttacaatttctaagtgggaaggattaaatgccaacgctaaatgtacaatgccatcgtcagtcataaaatcagatgaaaatccttgatggtatttaacatcccccgtcccactgccactatgcttaccggcaaactcatcgaataattctgaaggctttttacccaacacattaaccaatagattcaagcgacctctatgtgccatgcccatcacaatttctttcacaccatttctgctactatgacgaatcatttctttcattaacagtataaaagcatcgctaccttctaaagaaaagcgtttcgctccagggaatttcgctcctaaataacgctctaatccatctgctgcaattaattcttctaaaaatttcagttgctcttctcgggtgaacagcggcttatctaataacctctcaactttgcgttgcaaccacgtacgagcgtcaagatcgttaacgtgcataaattctaaaccaatcgtactgcaataagtctttttcaacgaatcggctaaatcacgtaacgaaatttgttccttgttataaacataacccccaatatcaaaaacttcatctaaatcattatcagaaaaaccataaaacttataatcaagcgttggtgcctccatacgttgccacatttttaacggatccaaatccgcatgtagatgccctcggttacgatgcccatttatccatttaagcacattaaccaatctcgcactaacattaggatctatcacccccactccattttgagaagtatcacgtgctaaacgtttaaaataatcacggacttttgaatgaggctgctcaagtgcgttctgttttggaagagaattgaaaacttgttgccaactttcgtcaacagcttgagggttatcaagataatcttcataaagatcctcgacataagactgattcgcaccacctaaagcactggatgccaaccattcactgatagggctattttttttcattatgaccacctaacttgattattgatagcaatttacagtgtaattttttccattatacatagatttagccataaacaatctatttatttgataagctatatcaatttcagctggaaattaaaaatcaaattacctatctaagcaataaaaaagttaaaaagttgttaataattttttatttttttgatctacatctcatttttaaacatccaacaccttatttgtaaaaataatgtaaaatttatgcagacagtaacaaaattaaacgttatattgaaaacatacacaaatattcaacatcttactttctttataaacttttaaactctcaagggggaatgtcttatgtctaaattaacagcaaaacttacacttagtgacggacgtgaatttgatttaaatgttcaacaaggaacgcttggatacgatgctgttgacgttcaaccgttagttaaaaataaattatttacttttgaccccggatttatgtcaactgcatcttgcgtttccgaaatcacctatatagatggtgataacggcatactgttacatcgtggttatcctattgcggatcttgctaaaaatgcggattatttagaagttgctcatctactgttatttggagaacgcccgaataaagaagaatatgccaactttataaagttggtcaaaaatcatactttagtacatgagcaaatttctcgcttcttccatggattccgtagagactctcaccctatggcgattatgtgcggggtaagcggtgccttagcagctttctatcatgattccttggatattaatgatattgaacaccgagaattaacagcaattcgtttattagcgaaaatgccaacgcttgcggcgatgtgttataaatattctattggacaaccttttatgttcccattaaacaaactttcttatgcaggaaattttttatatatgatgttcgcaacgccttgtgaaccttatgaagttaaccctgtattagaaaaagcgatggatagaattttcattttgcatgcagatcatgaacaaaatgcctcaacatctacagtgcgtaccgctgcttcgtccggagcaaacccttttgcttgtatcgctgcaggaattgcctctctttggggaccggctcatgggggagcaaatgaagcctgcatcaatatgctagaagaaatcggttctgttgatcgtattcctgaatacattgcacgagcaaaagataaaaacgatcctttcagattaatgggattcggacatcgagtttataaaaattacgatcctcgagctaaagtgatgcgtcaaacttgccatgaagtattaaaagaattaaacattcagacaccgctctttgacgttgctatggaattagaacgtattgcgttaaatgatccttactttatcgatcataaactgtatccaaatgtcgatttttattcaggaattatcttgaaagcaataggtattccgacatcaatgtttactgttattttcgctttagctagaacagtaggttggattgctcattggaaagaaatgtttaaacctggcaatatgaagattgtacgccctcgtcaattatacaaaggacatacagaacgtaaatttgatgccattgaaaaataatttctgtcagagttaaagtgaagctcgtctctttttgaatggcgagcttgattttttgtaccttattctatttttatcaaaatttacaataaatcatggtaaaattagactaattaatcataatcgggaatttttctatggcatacactaccttttcacaaactaaaaataatcaattattagaacccatgttttttggtcaaaacgtcaatgttgcccgttatgaccaacaaaaatatgaaacctttgagaaattaattgaaaagcaactctctttcttctggcgaccggaagaagtcgatgtatcacaagaccgcattgattatcaagcactacctgaacatgagaaacacatctttattagtaatctaaaatatcagacattattagattctatccaaggtcgtagccccaatgttgccttactgccattagtttccattccggaattggaaacatggatcgaaacttggacattctcagaaacgattcattcccgttcttatacacatattattcgtaatatcgtaaatgatccgtcaatcgtttttgacgatattgtcacaaacgaagaaattatcaaacgtgcaagagatatttcttcttactatgatgatctaatccgtgacagtcaactttacggattatatggcgagggtacttatacagtggatggtaaagcctgtaaagtcactttacgcaacttaaaacgccaactttatctctgtttaatgagtgtaaatgcgttagaagcaatccgcttttatgtttcctttgcttgctctttcgcttttgctgaacgcaaattaatggaaggtaatgcaaaaattattaaatttattgcccgtgatgaagcactgcatttgacaggcactcagcatatcctcaacatcatggcggcgggacaagatgatcctgaaatggctgaaatcgctgaagaatgtaaacaagaggcttatgagttattcgttgcagcggcggaacaagaaaaggaatgggctgattatctctttaaagatggctcaatgatcggattaaataaagatattcttgtgcaatatgtggaatatatcacaaacattcgtatgcaagctgtgggcttgccattgcccttccaagcacgttcaaacccaattccttggataaacgcttggttagtatcggataatgttcaagttgctccacaagaagttgaagtcagttcttatcttgtcggacaaattgatgccaaagtagatacaaatgacttcggcgatttcgatctataaaacacctataaaatcaaccgcactttgacctaggttaaaagtgcggttgatttttactaaaaataatgaagatttatcaagtttatatcagcaattaccggcaaacgcttacccatgccaacgaaatgcctttattggaaaaattagaaaaaaacggcattatacatgaatatcaatgtcgctcaggttattgtggttcatgtcgggtaaaactacaaaaaggcaaagtgtcttataaagaacagccccttgcctttcttaatccaaatgaaatattactttgttgttgccaattggaagatgatatagaaatcgaactctaatctatacacatgcaaaaatgcgacttccaattcacttatctcttaaaaaatatttactggttagcattttccttcgttgttacaaataatagccaatatcctactacagccgatacactagaaccaaacaagatacctaatcgtgcataagcggttaagtgtccatctcccccaccaaaagcaagactggctaaaaacatcgacatggtaaaccctataccacaaagtaccgaaactgcaaatatctgtttaaaattaataccttcaggtagttttgctatatgcagtttcactgataagtagctaaataaaaacaccccaatcggcttacctaacaataaccccaacgtaacacccagtgttaatggtgaagttaatgcttccatacccaaaccggacaaagaaataccggcattacaaaaagcaaagagcggtaaaattaaaaatgagctccaaggtgcaatagcatgttccatttcaaccaaaggttcgctgttatttttacctttcagcggtacacaaaaacctataatgacaccagctaatgtcgcatgcacacctgatttcaatacagatacccaaaggataatcccaacgacaacataagcgattaaatttgatactttgaaacgatttaacaaaattaagccaacaatagcaatacttgctaaaatcaacgcttttgtacttaaatcatgtgagaaaaataaagcaatcacaataattgcacctaaatcatcaataatagccaatgctaataaaaatacttttaaagcaagaggtactcgagtacctagcaacactaatacaccaatagcaaaagcaatatcggtcgccattggaatggcccaaccgccgtgataatcgggaacaccttgatttacgagccaatacactaaagctggtacaatcattccgccacaagccgcaattgccggaaaaatagccttctgatagctggaaatcgcaccaatcaacatctcacgtttcacttccaagccgacaagaacaaagaaaatcgccataaatccgtcatttacccacattaataacggtttattaagctcaacgatagatccgaattgaataatcaccggagcattcagaaaactaaagtaatgatctcttaacggagaattggcaaatatcaccgcccctacagaaaaaaccaataacaggattcctccggcggcctccatttgtaaaaattgacgaatacattcccgaattttttcagtcattattttcattattacttcctttgcataactaaaaacgcatataacaagtttttatcacgaacttttatttagggtcaaggcaaatcaaacaattttttctattgataaaaaaaacacaacaaagttcacaataatattcaacaaatttaacaaaactttatacaaaaacaaatttactcaacacatttaaagctgttgatacactctcaacgcatacgcatcggacattcccgcaatataatcgcaaataattcgcttacgatctgtttctgttgctttttgccaacgcattgctgtattacgaggcagtaaacgcaacggatcactgtcaaaaatttgaaacatttcagtaagcattctttgccctttatattcgacacgttgtgtatcaacatgtttaatcacatactcccatacgaagtgtttaaaaatagttaaaacttcaataacttcatcaggtaattcggcgttataacgtaataaaggctcggaaaaaccattatttattttccaacgtacatgggtaataaaataattcaccaatgcaccgatggcatttttacgctcatagtgtaattccgaaaaaagtttttggctaagtgattgtacattctcaacaatccattctgatcgacattctgttaatttttccaccgcactttgccactgctgaaacgttaccacgccaacaacaatcgcatcttctaaatcatgtaccgcataagcaatatcatctgcaagttccataatactgcaatccaaagatttataacgggttttcaaaacctcatcaggacgagtacgctcttttttatattgcccgaataaagtgcggtcattttccgataagggttcaagtaaccattcaaacattttcaaatcatcacgaaaaatcccttttcccggtttccacgctgaaatcttcacatatttagaatcaacattatcgacaattaccccttgatgatattgtggggaagaacgatctaaaatcgtaggatatttaacaacgcccaataacgttcgacgagttaaattcattcctgcattaggcgtataaggctcaagcttagttaataaacgaaacgtttgtgcatttccctcaaatcccccatgatgacgcatcatataattcaaggcgacttctccgccatgtccaaagggcggatgaccgatatcatgagcaaaacaaaggctttcaatgaggtcattagacggcagtattaatttaagttgtttttgcaactctgctcgatcttccttgagctgttgagctaaagaaataaaactatcaataagtttcatttgtgcaacgatactgctaccaatttgagcgacctcaagcgaatgggttaaacgagtgcggtaaaaatcattttcgcctatagcgtgaatttgtgtttttgcttgtaaacaacggaaagccgcactatgcaatattctcccacgatcacgacgaaaaggcggacgatgatctttctctctcggcggatcggcaagaaagcgttcttgccaagatgaattaatttgcaatttcatagttattcctcaaaaacaagcaaaatccacgtaattcatctcattatacaactcaacgtcaacaaaaataataaaatttatagcttgatttacttcttttattcgttttgttacgttttttcggtaaaatagacgaaattatcttgaacaacatcatcaatatgtggaaaaaaatcttttttattttatttttttgtgccatttctagtgtttcagccaaaaatccccgcattcttccttgttatgtagtgaaaattagtgatggcgatacatttacctgctcacttcgcaataacaaaaaagtaaaagtgcgtttacaagaaattgacgcaccggaaaaaggacagccgtttggtaaaaaagcccaacactatcttacaaagttaatttataaaaaaaacgtaaaattgcatgtgtcaagctatgaccgttatcaacgcatgctcgcaacggtttatacctcacaaggaaaaaatatcaatttagcgatggtaaatgcaggttttgcttgggcatatcaacaatatttaaaagatccgcagtatctacaagcacaaaaatacgcacaacgtaaacgtcttggcttatggcaagatcctcatcctgtatatccacatcaatggcgtaaacaaaaaaagcaaaagataaaaaaatatgatttttgatccaacattatttcgccggcaattccctttttttcaccaaaaaaatggtatcacttatctagacagtgcggcgaccaccttaaaaccgcaagttctccttgacgcaacgcagcatttttatgcttctgccggctccgtacatcgaagccaatatgatgcaaaacagaccgcactttttgaacaagcgagaaagcaggtgcaaaaactgatcaacgctgaaagtgaagaaaccgttatttggacatccggcaccacacaaagcatcaacattgtcgcctacggcttaatggcacaactttccccaaacgatgaaattatcattagcgaagcggaacatcatgcaaattttgttacttggcaacaaattgctaaaaagtgcggtgcaacattaattattttaccgttgcaagataatttactcattgatcaacaaattctacaaaaatccttaaacaaaaaaacgaaattagtcgccttaaatgtgatctccaatgtaacaggaacacaacaaccgctgacacagcttatccccatcatacgagaaaaaagcagtgccttgattttattagattgtgcacaagccattaaccatcaaaccattgatcttcaaaggcttgatgcagattttatcgttttttccgcacataaaatttacggaccaacagggctaggtgtattaagtggaaaacgttctgctttagaacgattacaacccagttttttcggcggaaaaatggttgaacaggtttcaaaacaagaaactgtttttgcctctttaccttatcgcctcgaaagcggcacgcctaatattgctggcgtaatcggtttcggtgcggtattaaattggctggaacaatgggatatcatacaaggggaacaatttgccgtgcaactggcggaaaaaacaaaagagcggttaaaaaattatcctcattgtcgcctatttaattcgccacacccaagcacatttgtttgctttacattcaccacaatcgccacatcggatattgcgaccctacttgcagaacaacatattgccttgcgtagtggcgaacattgtgcaactccctatttacagcgtctaggacaaaaaagcaccttacgcctctctttcgccccttacaataaccaagaagatattgaactgttttttagtgcattggataaaagtttggagttattggcatgattgaacaaatcaaacaagcgaaaaattgggaagaacgttatcgcttaatcattttggcaggaaaaaatctccgccaaccgacagaacagcaattggctgaaatggaaatcattcaaggttgcgaagtcaaagtatggtttaaatgcttacttaaaacagaccgcacttttgaatgccacgcttatagcgaagcaagaattatgaatggcttattatggatgttattgcaagaaatgaacggcaaacaggcgactcaattggcagaatttgatttaatccaatatttcgatgaactcggcattgcccaacgtttaaccgatacaagacttaacggcttaaaacaaattgagcaaaagataaagttaatgccttaagacggtatacaatactactcaaacgttaacattcacatcgaaaaatacaaatttgttgatgaaaatctatgcttatgcaactcatctccttgaagaagagaaaaaatagacgttaggtaagatttacaaggcaaaaggcttttaaattacttttttacttgttttttgctttgtaaatactctcaataaacttgctaaatttattttaattactcaaaatatacttaatgaggtgcgacttgttttgatgaaaaagcaaacaagtcaagagatgaaattaaagcagttattgatgaaattttagggagtgaataatgaaattaccaatgcaatctaaagaagcaactaagtttgttaaagaaacgaataatggcgatttaaagcctaaatctaaagtttcctctattcttctctccgagaaacaaaatcaatttgtaaaagattacgttcgacggtgaagatattagcccatttcttaaagaatggattgagctatactctgaacacttgaaactaaaaatgaaaaatatattgctgcttgtgctgattcattatgccaagcataatactaaatttgatgttgatagtattttatagctttaaattgcttgcaaaatacttttattttacttttatattactttttatcttttagcaaagatgaaattatgaggagaaaatttatgattactgaagaagagaaattaagtagaaaaaaagctgttcaatctgcgattgataataatcgtttagaggggttagagcctagtaaagtttttattgatattgctcaaaattgggtcaatggaaatttgactaatgatgaatttggaagaaaagtttatgaaatacacgggcttcgattcccacattgatgaaaataaagtcttaaaaaatcattttgggattaaagatcaaaataagctagatcaaatagaaagagatattacctcttacaaagaatctattcttaacgataatccaataaaaggaaaatttgaccttaagcatttacaagatattcacaaacatttatttagcgatatttatccttttgcaggaaaaattagagacggctatttgcaaaaaggggagcaagatttcactatgggatatagaattgttccacaagctgaaaaattgtttagtgagctaaaaagtgagaatttcctaaaaaatactgaacccgataagatggctggacgcttagcttattatatgggcgaaataaacgctatacacccttttagggagggcaatgggagaactcaaaggatatttatttctcaattagcaaaagaagcaggttttgaattaaactttaataaagttagtcaaggtgaaatgataaaggcttctattcaggctcatagatgtgattatacagccttagaatctattattaaaagagggttgaaacctcttttttcaaaagttcttgatgggcttgctactcataaaccaacagtaaatcaggcttaatgcggcattctcatcacctttgctacagtaggggcgaatcacattcgccccatgacatcaacccgaacggagaataaaatacattaaaaggcggatgtaatctgcccctccccttgtttctttaaattgtcatcaatgcggatatttaagtttgaagttgtcataatttaagctcacattgtagataaaaagcaaattacattacatttacatttcattataatttaaatataattagaacctactttaaatagcgtttaaatgtcatttactttggaggtttattatggattatacaaattttaatatgcgacttgataacgacttgcgtggacgggcttatcctattttggagcagtatggattgacgccaagtcaagcggtaagaatgttttttaatcagattgcacaaaccggtaaaatacccttgtcgtttgattgggcggaaaatcaaactttaaccccaaaagcagccgcacggttacgccaaactgagcaggaattcgccaatggcgaatttgaacgcttttatagcctagatgaactcaatcaagcgataaaggagatctcgcatggctaaacgcaaatttgatatggcaaaatcttttaaacgtgatttgagaaaacattacttggctttagtcggcgaagcatgggcagagatttcaaactgtcttttgaatgacttgccaattcctgaaaagtatcaagatcacccgcttaaaggcgataaatcaggctttcgagactgccatgtcaaaccggatttagtgttgatatacaaaatcgttgatgatgttgtggagttacattaccttgatagccatagcgaaatttttggctagcctaccgctctttgttacaaaaatgtcaaaaaaaaccgctccgaagagcggttaaatttttgaggttttattatatattatatattagaagtaaacacgtaaacctgctgcgtagaaactttctctcacgtttttatcttttgtaggtgctttaacacggctattagcaaattctgcataggctaataaatttttgttaaaggcatagtcagcaccgacgataaatacgttttgtactgctttttgatgttcttctaactctaagtcagctaattttacataagaaagtgcaaaaggctgttcaaattttttagcactagtatcactagcacttcttaaactattacgttgccattgtgtatagacatttaagacatccggtaatactgcatattttgcaccgacttcaacaaagcgagcagaaccttgaaattcgtgttgaactttagattgatacactgtttgaccgtattcaataccgaaagatgccggtccgaattctacttgcgttgctaaacgccaagcttgttgttgattatcagttttagaagcaataacaccaactttggtattttcgttacgaactgtataacccgcattggcatttaccttaacatcaccaaaattacctgtatagaacgcagacaatccgtaagtattttttaatttaacatgttttttgtctgaatcctttccttgaatatcttttttatgtgcttcaccgaagccataatcagcaccaaaacctaaagtttgcccttccgctaattggatatctgctgtacggaaagacaccactttatcaccggaagtaaccaagttgttgttaccgccaaagatataggtatgatcatttaattgcacatcatccgcagtggtattttgtttaccgaaagttactttaccgatatcgttatgttttaagcctaaccataatttagaaagtttgatgtcgttaaaagatgtatcttctttttcagcatcacctaacccgaaacgaaccgcaccgattgcttttaagccgttttgtacttcatgctccgctttaaactccacacgagagctgttattacgtaaatcggtacgttgagcatcaccgaatttacctaacattacatcaatacgaccgccaacatctactttggtaccgttttgattataaacagttgttgcgtttgctgatgccgcaactgccgctaccgctaatgctactaatgtctttttcataataaaattcctttcaaatttaaattattttactactgaattgaacctttccatatatgaaaagtccaagccaacttttaaaaaaaagcgagcctatattggcaaagaaaccgtttacagtcaactaaatttaataaaaaaatgctaaatttagtgatctaaatcacactttttgaataatttttgaacttttttgcggtacttttatttattttaatgattcgcttaatatcgtttattttccagcaaatacgctacttttgcgttcttttttctctatacagctatcaaccgtatgatcaggggttatcttgaccactaaagggtaaaaatttcattctggcgttaatcatctcaatacttttgaatacgcttgattgtttttcatttttctattttgtataatcggaactcaacgtttaattaaagggggaaatatgtacgccattgcttttgatctcgatacttctatgttaaaagagctatactccaccgagagttggcaaaatgcctatggtgatattaaaaagacgcttgaatctttaggttttgatcatcaacaaggtagcgtatattttggtaacgaggatatgactgcggttaaatgtgttttagctacacaaacactatctaagacttactcttggtttaagccatcagtttcagatattagaatgcttagaattgaagagcttaatgatttatcccctgcgttataagcattattcttttactttataacctctaatacttgttagaggtttttttgtagcttgtgaaatttacctctctcatcgcttaaatattcacttttttcgagcaaataccatgcctttgctttattctttttcttgaactatacggctgttaaccgtataatttaggactattttaacaattaaagagggcgtatagaaatgagaacacaagtaacaaaagcaagattggaagctaaagtaaaccttgatatatacgaattattaaaacaagccgccgcaattacagggcgaaccttaaccgactttgtggtaagtgtagcttatgaagaagccaaaaaaactatttcagaacatcaaattttacgtttgacattaagcgatcaggctttactcattgacaatctcagtaaaccgtttgagcctactcagtcaatgaaaaatgcacttgatgtgtatgaagaatatctttccgttgcggggaaaaataatgataaatgaaaatttaccttatttaagcgtattacctttagaagatttgacaattgataggaattcattttcctgctcggttgagcctttagaaacctatttttataagtatgcttctcaagatgtaaaaaaaggaattacaaagtgtttcgtgcttataaataaacaacaattcggaattatcggctattacactttatcggcactatcaatccctattaccgatatacctcaagaacgaataagtaaaggtattccatatcctaacattcctgcggttttagtgggacgattggctattgatacgaatttccaaaatcaggggtatggcaaatttcttattgcagacgctatttataagataaaaaatgctacggtaggggctgcaattttagtcgttgaggcaaaaaatgatcatgctgtctcattttataagcgacttgggtttattgagtttaaaaatttgaaaaaaacacacagaaaattattttatccgctaacttgaaattttcttgaacagttgcttttttagtggtgttcagttccgacaatcggtttgattttttcccatttccgacaagatgggcaattccatgatagtttgtgtgtttggtaaccgcaatgactgcaacgataatcaaagcctcgtgcaattctatctcccacgattttgtgcaataaaatcaaactttcttttgctttgccgttttcagcagcatcaatttggtattgaataaaacgatgtaaaataaatgtacttgggttttgttccagttgttggtgtaatttagtttgtgccgcaacaatgccgtctttttctgcgataagatccgataaagctaaatcaaccgcactattattgccggtttggcttgcccgaataagaaaaagttcaaagttgtctaaccgatttaattcttggtagcaatattttaatgccggtaaaatttcgctcatgtaatccgcattttgtattagcacattttctaaatgttgcaccgcacgttgatattctaaattcacaatataacgttcagcgatgaggatagaggctctaacactcgtttttgaaacattcaatgcttgtttcaaaatatggattgcttgagcttgttgttgctcatcacttcctaaagtcagggaatattcgcagtagtaatgtgctaatgcaatgttatcttccgtaggcgaaattttggcaagtttctcagcaacattgatcgcttttttccattcttttgttttttgataaatgacggctagttgttgtaaagcattttcagcgtagttcggttcgtcaatcaataaaatataaagattttcagctcgatcataaaagcctatcgtcaaaaaatcttttgctaattgttgtttagcaagaagtttttgttcgaaggtataatttggactgctatccaatgcttgatgaatacgcaaagctctatcaacttcacctcgagaacgatataaatttcctaaggttaattcagcctcaaattgtgaacctgtttcaatgttattttcttgttcctgcttttgtagaatatcaaggaagagatcagccgctttttcgtgttgattagataataataaattaatacctgttacataatcacgagaaaatttattgctaatcgtatcttgatcttttcttgcactacgatgccccatataccagccgtaagctgctgcaatcggtaaaagcaggaaaagtaattcgagcattatacaaccttactctcgatttttgtttaattcatcaattaacgctaattgatgctttacttggcgagataaaaaaagatttctaaattttaatttgatatagaagaaagcggtaattaaccaacctaaaagcagacctagcccaaacaagatagccactaaagttgataaacgtatttcattttgtgcaactacataattaaaggtaataatttggtcattgttagcaccaatagttacagcaactaaaacaaccgtaatcaataaaacaaaacctataatatatttgatcatctgtatctcctataactttctatttatggttaaatcaattagcatcactaaaagctcggtcattatgccaaaaaaataaaaaaaacgacactttacgcgtcgtttttttatattttatattacgagtaaatattaacacgctctttcagttctttaccggctttaaaatgaggtacatatttagcacttaaatctaccttttctccggtttttggattacgtcctattctagattgacgaaaatgcaatgaaaaactaccaaatcctcgaatttcaattctttcaccgttttctaatgcttgtgataattgttctagaatgtcttttactgcattttctatatctttcaaaggaacgttaggattggttgatgctaaattttcgataagttctgactttgtcataatatactcctagtgccggttggcataaatcctataattcatgccaaccaaaaagtgaatgaattattcaccttttgccgctttaaatgcttcagccattgcatttggaataacaatttcttctttattcacatttgcaactgccgccgcttcttctgcttggtcttttgctttaacagatagatgaacgatacgagatttacggtcaacaccggtatatttcgcttcaacaacatcaccaacaacaacttcattgctcaaatcagctgtacgaatataaccttcaacgccgcttactaattcaactttagcaccttttgcgtcaacttcaaccactttagcactgaccacagcaccttttttgtttaccgcaatgaaattattaaacggatcttcttccagctgtttgatacctaaagaaatacgctcttttgcagaatcaacttgtaatacaactgcttctacttcgtcaccttttttatagttacgaacagcttcttcacccggaatattccaagaaatatcagataaatgtactaaaccatcaattccgccttcaagaccgatgaaaataccgaaatctgtaatagacttaatcttaccggaaactttatcacctttgttgtgagtttcagcaaactgtaaccatgggttaggtttgcattgttttaaacctaaagaaatacgacgacgttcttcatcgatttccaataccattacttcaacaacatcacctaaatgaacaactttagatgggtgaatatttttatttgtccaatccatttctgacacatgaaccaaaccttcaacaccttctaaaatttcaacaaagcaaccatagtcagttaagttagttactttacctgttaatttgctgttcaccggatgattttctgcgatggctacccaaggatcttgacccaattgttttaagcctaaagatacacgtgttttatctttgtcaaatttgaggactttaactgtaatttcatcgccgacactcacaatctcacccggatgtttaacacgtttccacgccatatcggtgatatgcaataaaccgtcaacaccacctaaatcaacaaatgcaccgtaatcggttaagtttttaacagtacctttaacttctgaaccttcagctaagttagctaaaatttcttcacgttcttgactattttccgattcgatgactgcacgacgagataccacaacattgttgcgtttttgatctaatttaatgactttaaattcttgttctttacctaataggtgatccgcttcacgagttgggcgagtatctaccaatgaacccggtaagaacgcacgaacaccgtttaactcaactgtgaaaccgcctttcactttaccgttgattaaaccgataacagttgcttgttcttcgtatgctttttctaaatcaatccaagattcttgacgtaccgctttttcacgtgaaagtttagtttcaccgaaaccgtcttcaacagcgtccaaagcaacgtttacaacgtcacccactttaacgtccaattcaccttgagcattttggaattcttccgccggaatacgagcttctgatttcaaacctgcatctacgtacacgaagcctttttcgatagcaacaacagtagcgttaacgattgaacctacacgagtttcaaggtcttttaatgattcttcaaatagttgagcaaaagattctgacataattaatcttctaaatttaagttaataacgaccactttaatttccataaaaagtggggctgataataaatgtttattcaatccttgaacaaacgagttcagattccaacggagagttcatcacacgactgatatgctctaatgcttgtttgatcacatcatcaattgttaattccgtgctatcaagtaataaagcatcttctgcgggcttcaagggagcgactggacgatttctatcacgaaaatcacgctcttttatctcggtcaaaatctgtgcaaagttaccattaattcctttattttgcaactgtttatgacgtctttttgctctttcttccgcactagcatctaaaaaaatttttacttgagcatgcggaaataccactgtccccatatcacgcccatctgcaataagcccttccccgtttgcaaaatctcgttgtaattgcaataacgctgttctaacttgtggaaacaccgcaatttgagacgcagcttcagccacttcttgtgtacgaatttttgtactgacattctcattttgcaaaatgatattcacttcgccatgttgtggaataaattgaatgtcgagactacgggctaattcagtcagtgccgtttcatcatcaagtgccacacctttttttaacgctgccaatgctgtcacacgataaattgctccgctatctaataatcgaaatccaagtttctcggctaaggcataacatagcgtacctttgcccgctccacttggtccgtcaacagtaataatcagatttttattcataaattgaaccttgatacaaaaatgcgtcatatatcatgacgcactttattttttattcggctaatttcttctcaacagccttcaatcgcttgtttattttatcaatatctaaagttaatgcggcagttttacgccataccttatttggctgtaacggaattccggaagaatatattcccggttctgtgattggtcgcatcaccatacccattccagtaattgttactttatcacaaatttccatatgcccattaataacacttgctccgccaattaagcaatagcgaccaactttcaaactacccgccataataacaccgccggcaacagcagtacctgttccaatatgaacattatgtgcaatttggcaaagattatctatgattacattatcctcaatcacagtcgcatcaagtgcacctcgatcaatacaagtgcaggcaccgatttcaacatgattgcctataatgacagttcccgtttgtggaattttaatccagcgaccacgatcatttgcataaccaaatccatcactaccaattaccgcacctgattgaatgagacaatctgagccgattttaacgtcatgataaatattaacatttgcccaaagctgggtattttcaccaatctgcacatgtttaccgataaagcaacctgcaccaatcaccacattgtcaccaagtataactccgtcttcaatcaccgcattagccccaatggaaacatgttgacctaactttgccgtatcggaaatgaccgcactttggtgaataccttgagcggctttgggtgtgctgtccatgtattgtgccaaaatagcgtatgcaacataaggatcttttactacgagcaaattactttgtgcagaacagaattcgatatcactttcggttacaattaatgcaccggcttgtgattgaagcaaatgttctcgaaatttaggattggaaataaaggtcagttggttgttatccgctttatctaaaggtgctatgtccgttacaataacatcggcgttaccacgaatggtagcgccgatttgttgagccaattccagtaaagaatatccttgcattacttagcctttgcaggagctggagccggaatagcttttagaacttcctcggtaatatttttaccgtcagcaacataaattgccgttttttcatccaatacaattgtaaagtttttggctttagctacattcgttgtagctgtttgaacctcttttaataaacgttgagtaatttcggcatcacgtttttgtgcttcagcttgaaacgctgcaacatttttttggtgttccgctaccagcttgttaaactcgtcattacgttttgttaccaatttagcaatttcatcttgacgttttttgatatcagcttgacgtagtttcggtgcatctttttccaatgctttactttttgtttcaatttctttttcaaaattggcacgtttttcaactaatgctttatctgctgcttccagtttttctgcaggtgctttaaattcctcatttaatttttgaaactcaagcaagcgagcagggtgatttaaaaacaagtactctgtattaacaacagcgatattatcacttgccattgcaattgatgagcctaatgcgatagaaagagcggtcagttttactgcatttttcattgtttgaatatccttaataaattaattttaattgagttccgtacaatttaattatacgggtttcatatcagactattaattatagccgaaagttccctaaaaagaaccaccaatactaaattggaattgttcaatttggtcaccttgatattttttcagtggtttagcataagagaatactaaaggtccaatcggagaataccattggaacgcaatccctgctgaagctcttatacgagctgggttcccgtagtcaggtatatttttatctctagcaaatggtttaccatctgatttccatttagtattccatacagaaccggcatcggcaaagatagaggttctcactgagcgttggtttttctccgctacaaacggcgtcggaacaataagttcaatacttgccaatgtcatggcatttccgccaacaatatctttgctatggcatgtatattggttttggcttgtactttgcatacctccagccgcactgttttgcattgcactacaatttctattcccctgataaatcgcttttggtcctattgctccatattcaaaaccacgtacagttcctatgcctccagcagagtaagtttgataaaacggtaaacgtttaccgccaaaaccgtttgcatatgatcctgacaatctacctgtcagtacccaataatgatcacgatccaatggataaaaaccctgcacttcagcactcactttatagtatctgttatctgaacctgggattgtcactttaccgccaacatttgctcttactccggaggtaggcaaatagccacggtttaagctgttatagttccagccgaatgaaaattcaaagtcatgcgatttaaaattccatctattagaatcaggataccccattgatttgcgatataaatcacgattatattctttcgtcacattttttaattggctataaatatgccctaaacttaaataataggagttattttcattgaccggaaaacttaaatttccacttagaccgtaagttgtacgtccataggcggctgcagtatcactttttgagttatcgtgtttttcaaaaaatgcgtttccacctaaacttacaccatctttagtaaagtacggttcgttataacctaaattaagacttgtgccataattgttgcgtgaaccggctaaactaatcgaggaacccatgcccaagaaattatcctgtttaatacttgcctgataacttataccactttcagtaccataaccaataccgaagttcaaactccctgtattgcgttctttgactcgataaatgacatcaacttggtcgttaatttgttgattggtttgagtttccgtttccactgactcaaaaaatccggtacgctctagacgaattttccctaactcaactaattgagatgataaccaagcaccctcttgttgacgcatttcttgacgtaatgtgctatcggcagtaatcgtattcccctcaaagcggatttgacgaacagaataacgatgtcccgcatcaacaacaaacgttaaatcaatcgttttgttctcttcattaaagactgaactaacatctacttttgccgttgcatagccttgctcgcttaattttgcttttatcaattgttcaacactgctaacttcactacgacggaaagtttctccgacataaatgtttttaagtaacggtgctaactcttctgacataccgcctacatcaccaacgattcggacactatttacagaatacttatcaccttcgttaacttgaattctaactctaacctcagttttttcgtcatttagctgaacatcagtaccaacgatttgaaattttgcataaccatgttctaaataaaaatcacgaataagatccaaatcttggttaaattgattggtatcaaatttattcccaaacaacttccaccaagcatccggctgtaattccatccgctcttgtaattggctactgctaaatgcttcattgccctcaaaacgcacttctttcagttttgccacatcactttcttttattttaagttttacttctgcccgatcatttgataatggattaacaattgcctctacagtcgtattataacgaccgacagactgataatgatcaactaaacttccacgaaacgcttccaatttttcccgatttaaaatatcaccgctagcaaatccgttcgctttcaagttttctcgtattgcttcactaggaatagattcatttccctccactttcacttccgcaatcactaagcgtggtactacagaaatgactaaggtatttccttcacgaacagcttgcacattatcatagccacgcaaaaataatagtcttacgacatttgaaatatcactctccgttgctttttgtccaattcgaaccggcaatccggataacaccgcactttccttacctgcttgaataccgtttatacgaatatcttgcacgacaaacggtgcggcaaccagaccagtcgagccaaataataggcttgcaattaacagttttttcattgttagttctatcctctaataaagaaatatctaagagtctgtttatcgattaaacaaaatcctgacgattataaacgtaaaaaatcattaaacaatacaaatattgttaatatcaataataatcccgtaccaattttatacgcaatattttgcatttgctcagataagggcttacctttgagtgcttctatggctaaaaaaagtaaatgcccgccatccaataccggcaatgggaataagttcataatacctaaattcacactaatcaacgccataaagctgagatagtacacaaaacctatttccgaagatgccccagcacctttagcaatggaaatcggaccacttaaatttttagctgaaaactctcctgtaaacagcttaccgataatttgaatagttaatttgctcaattgataagttttctcaataccttttataaacgcctcaaaaaaaccatattttaattctgtgcgatattcatcacttataggataaatagtcggtgcgacaccaacgaaccatttccctttttcatttaagtgcggtgtaatcaccttatccagccattctccatgacgtaatacttgaacattgaaactatcccctttatcaacaaaactgataaaatcacgccatttcattggttcattttgataatagatttgatcaccaattaataaccctgcccgttgtgctggagaattttcaacgaccttagacagtatcatctcaattttagttcttaccggaacaatccctaatgcaccaaaggccgtttctttttcaggatcaaagttccattcagataaatccaatacttttctttgctcgatatttgttgttgaggacttcaaaagtgttagcgtaacgctttcctcccccatttttgtagcaagaaccatattgatactttcccaatccggtgtcgatgtcccgtcaattgccataatttgtgagtaaggttcaagccctgccttctctgccaaagattgaggaaccacattttcaataacaggtttaatactggggataccgatagaataaaccgtcaaataggctaaaatcgcaaacagaaaatttgctataggacctgccgcaataacaaaagcacgttgcaaaatggatttattgttaaaggcttgtgattttaagttgtcaggaacttgttcattacgttcatccaacatttttacatatccgcctaaagggattgcggacacggcaaattccgtgccttgtttatccactttagaccacaagactttaccaaagccaatagaaaaacgatgaactttaataccgcactttcgtgctgcccaaaaatggccatattcatgtactgaaaccaatacaccgataacaatgataaaagaacctaaagaccaaagaaatgacataataatctctacaagaaataaaaatagaaataagcaaaaaacggaactgccgccgttaaactgtcgatacgatccaatattccaccatgtcccggaataagttgactgctgtctttaataccgcactcacgtttgaacatactttccgtcaaatctcccactatggaaatcgctactgtagtaacagataaggaaataaaagacagacgttctaacacaaaaagatctgccggcacaagattaataaaaagtgcggcgaaaataccagcagtaatcaagcctccaaatgccccctgccacgttttcccaggtgaaactttcggtgctaatttatgtttacccaatgctcgacctgcaaaatatgcacctgaatcggctgcccaaactaaaataaatacataaagcaatagcattaaaccatcgtaaggattagaaacgtaattgtccaaacgtaaacgtaatacagcgatgaagaaagggatcaaagtgcagaaagcaaaaataaattgtaagaaagaggatttagcccaaatttttgccgaagcaggataacgaataacaaaaaataaggcgatgaaccaccaaattaccgccatcaataatacaggttcagcatagttttcaaacactctgccaaccgttaaaaaatgtgcctcaccaaaaatccacaaaaaaataaaagccccaaacagcccagtaatcattaaacgccaaaaaaattgtttaacgccaccaaactgtgtccactcccaaatacctaaagcaacaacgacaccaagagataaagcaaaatagaaaggggaaaaccataataacgcaatcaaaacaaccgcaattaatacgatagctgataatattcgttctttaagcactactcttctccatcattccgaactgccaaaacgacgttcacgttgttgataagctaatatcgcttgattaaattcctgttcattaaaatcaggccacaatgtatcggtaaaatacagttccgcataagcaatttgccataataaaaaattactaattcgttgctcaccacttgttctaattaataaatctactggaggttgtgaacctgttgttagatgatgttgaaaaatttgttcatcaatctcatcaatatgcaatttattttcttttaccaattgtaccaattgacacgtcgcctgaacaatatcccaacaaccaccataattcgcagcaatatttaaagtaagtgcggtattattttccgttaatttttctgctcttttgattttttcttgcaaacgctcattaaattgagaaacatcaccaataatttgtaatttaatgttatttttatgtaattttttaacttcaatatccagtgtttgcataaataaggacatcaaagcacttacttcactttcaggacggctccaattttcactgctaaaggcatacaacgttaaaactttaattccgatttttctagcataagaaaccgactctcggacagccttaatcccatttttatgcccccaaatacgcatttttccctgttgtttcgcccagcgtccattgccatccatgataatcgcaacatgctgaggaatattgtttaaatttaatgctgttttcgtcattatttaatcgatttttatcgaagtgaaattcggttgcgactataccataagttgatacggcttgctatgaaaaggcaaataaacagaaaaaaaatcctcttttaatcggtaaaaaacataagtttagtcgtttagttttcaggcttaacaaataaaatctcaatgttttcatcattaatgctttaaagctgatattttcttttatcaccaatatcaaaatgtaagggcattctccatttttgaatagaaaccataagaaaaagtaccgcacttacgaccgataaaatatacaccatataagtcaaattaaattgtaggcttaaccaaagtgtggcaacaaaaaatggttgtaaatttaatgcaaacacacgaaaacaaaaatattctttgaatgccaatccccctaaagtcaacaatgctccgcccagtgcaaactccggtaaattaaataattggcaaattaatgcaacccaagttgccatttgtaataacaagcggatattttttaaataaatatgcaaagaagaggcacataacgttgctgcaataagtataccgtaatgtgcaatttccggcttataaggtaaaagtgcggtcatgattgcggctaaagtgaaaccgcaacgatataaaataactgttagataatcccaatgatccatagaggatttaatttgaggatctgccatattatgttcctgatgtacgtaaaacaaagctattagccaattctcttgcctgcttatctaccagcaatacatcttctatactggtaattacttggctttcaattttttctaataccgctgtgttaatttttgctatatccgtaaattttattctcttatttaaaaatgcttcaacagccatttcatttgccgcattcaaagctgttgttgcatattgtcctgctgagaaagcctctatagctaattttaaacaaggataacgttggtaatccggttttaagaaagtcaacccacttaattgataaaaatccaatggttcaacccccgcaaaagtgcggtgaggatatgccatagtttctgcaatcggtgtacgcatatcagggttacccatttgtgcgataaccgaaccgtcaatataacgcaccatagaatgaataatagattgcggatgaataattacttccatttcatcagcactggcattaaataaccagcgtgcctcaatatattccaaccctttattcatcatcgttgcactgtctactgaaatttttttgcccatagaccaatttggatgtgccactgcttgctcgggtgtaatatgttcaaatgctttcaaatctgtataacggaaaggtccccctgatcctgtcagtacaattttgctaattcccaattgcgttaatggacaaaaaccaatttgttgctgagcttgtggaggtaaagattggaagatggcgttatgctcactatctaccggcaaaagttgagccttattctttcgtacttcatcaataaaaatcttgccacaggttaccaatgtttctttatttgccaataggatacgtttacctgcttgtacagcggataacgtcggcaataaccccgccgcaccgacaatagccgccattacttgatctgcctcaggatgagcagcaagttcgcaaatcgctttttgtccgctcaacacttcagttttactctccaagaatgccaacttttctcgcaattttttcgccgcactttcatcattcattgccacaaagtgcggttggaattttataatttgttgtagcataagttcgacatttttaccgccaactaatgcaagagcttgatattgctccggattctttgcaataacggaaagcgtactggtaccgattgagccggtagaaccgagaatgacaagtttttgtttattattcatactattacaaatttatcaaatatataacaaaaaacgcagtaaaaactgcgttttcgctaaattaatcatattagaaatcaagcaattctttttctttgtcagccaaaatttcatctacttttttcacgaaagtatccgtgattttctgaatttcatcttgtgctttacgttcttcatcttcactgatttccttatcttttagtaaggctttaatttgatcatttgcatcacgacgcacattacggatcgcaattttaccttgctcaccttcgcctttcacgattttaattaaatcacgacgacgctcctccgttaatggcggaagaggaactcggatagttgttccagcagaagacgggtttaaacctaaatcagatgttaaaatcgctttttctaccgcactaatcaaagaacggtcaaatactgttactgccaaagtacgtgcatcttcagccactacgtttgcaagctgacgtaaaggtgtcggtgaaccgtaatattccacttgaataccatctaacaaactaggctgtgcacgacctgtacgaattttagcaatatgtgttcttaatgtttcaaggcttttttccatacgctgttgcgtatcttttttaatttcgttaatcacaataattcctttaaaaataataagataagtttaaaatctgtgttaatttactactaatcgcaaattaacgtcccttcttttttacctaaaatgacattgcgtaatgcacccgttttgctcatgttgaatacacgaattggcatattatggtcacgagcaagtgtaaatgcggctaaatccataacttgtaattctttttctatcacttcagcataagataatttgtggtaaagcactgcgttgggatttttcacgggatcgcaatcataaacaccgtcaactttggtcgctttcaacacaacatcagcctcaatttcaattcctcgcaaacaagctgctgaatctgtagtaaaaaatggactgccggttccggcagagaaaatgactacccgtttttcacataacatttttatggcttccgaccagttgtatgtatcacaaatcccattcagttggaaagctgacattaatttggcatttacattggcacggtgcaacgcatcacgcattgccaaaccgttcatcactgttgcaagcattcccatgtgatcaccaacaacccgattcatacctgctttggctaacttggcaccacgaaataagttgcctccgccaagaacaactccaacctcgacacccaaacccaataaccctttgatttccagtgccattctatccaagatagacggatcaataccaaaaccctcgtcgccttgcaacgcttctccacttagtttaagtagaatgcgtttataaattggttggctcatttccttacccctttcaataacccagagacaaaatctcgcttattatagttcaacctgactggcgtgcaagtattcattgaaaaatacccttaattattttaaaccagttttaagtcaggattaatcttgaacgctaatttatttacacttggatactgacgttggatcaattgcaataaaggcgattgctgaaagaggaaagcttgtcgtacagttgcattaacgacttcaatccacatagtgtcagattcaaaattgataacacgataaaaccccttgaactcaataggaaataaatgttgtatttgttcatttaattcttctaaaagcgacgctttttgaatgatttgcatcaaaggggagttttccaataactcattgaaatttttcggcttactgtatctcatcttgattttccaagtttcgtcctaatattttatacagagttatgacattgtaacgaatttccgttacaatacgcagaaaattttgtggtaatgtaaaacaatgattttaattaaagggaaacagtatttttggtcgcaactgctattaagtgtcatagcgttctttactttacccgttgcacaggatatagctccacaaaagattactaatgattacccaaaaacacaaaatgtaatacagcaactttactataccgcatcaaatattcaacaagtgcaacagcaacaattacgacaaattcgttatgttgttactgaatcatcaattccttttcaatttgtaccgctctttttagttggacaattcagtcatctcccccctattcgtgccggtccgtaaagaaattaaatttaaatttatttcagtgccaaatattattaggcgaatttgtttattcaattataaaagaaaaatactatgttaagaactattgttacaaaaatctttggtagtcgtaatgaccgaattttacgtcgtttaaataaacaagtgagaattatcaataagttagaggctgaatttgagcttttaaccgatgaggaattgaaatcaaaaactacagaatttcggacaagattgaaaaatggagaaaaactggaaaatttaattccggaggcatttgcaaccgttcgtgaagctagtaaacgtattttaggcatgcgtcctttcgatgtgcaattaattggcggtatggtgttaaacaatcgatgtattgcagaaatgcgtacaggtgaaggaaaaaccttaactgcaaccttaccttgttacttaaatgccttaacgggaaaaggtgttcatgttgttaccgtaaatgattacttggctcgccgtgatgcggaaaccaatcgccccttattcgaatttttaggtatgactgtaggcattaatgttccgggtttatcaccggaggaaaaacgtgccgcctatgcagcagatattacttacgcaacaaatagtgaattgggctttgattatttgcgggataatcttgcacattcagctcaagatcgctttcaaaaacacttacattatgctttagtagatgaagtggattctattttaattgatgaagcccgtacgccgttaattatttccggtccggctgaagacagttccgagttgtatatggcaatggataaactgattccaatccttatccaacaagataaagaagatactgaagaatatcaaggtgatggggactttacactggatctgaaaaataaacaggctcatttaaccgaacgtggacaagaaaaaattgagcaatggttaatggaaaaaggttttattaatgaaaatgaaagcctctactcccctgctcgtatttctttattgcatcatatttacgctgccctacgagcacacaaactatttgagcgtgacgtagattacattgtaaaaaacggtgaaattgttattgttgatgaacacaccggtcgtacaatggctggtcgtcgctggtctgatggcttacatcaggcaattgaagcaaaagaaggcgttcaaattcaaggagaaaaccaaaccgttgcttctatcacttatcaaaattacttccgtctgtatgaaaagctggcaggtatgacaggtacggcagatactgaagcatttgaatttcaacaaatttacggtttggaaaccattgttatcccaaccaataaaccaatgattagagatgatcgcactgatattatgtttgaaaacgaaaaatataaatttgatgcgatcatcgaggacattaaagactgtgttgcacgcaatcagccggtattagtaggtacgatctctatcgaaaaatcagagttactttccaatgcactaagcaaagcaggtatcaaacataatgtcctgaatgccaaattccatgctcaagaagctgaaattatcgccaatgcgggatatccaagtgcggtcactattgctaccaatatggcagggcgaggaactgatattgtactgggcggtaactggaaagctgaagttgctaaattggataatccgacggaggagcaaattgaggcaattaaagcggcatggcaaattcgtcatgaaacggtaaaacaagccggtggattacatattatcggaacagaacgccatgaatcccgccgcatcgacaatcagttgcgtggtcgttcaggtcgtcaaggtgatcccggttcttctcgtttttacttatccttagatgatgctttaatgcgtatttatttaacagaaggtaaattaaacttcatgcgtaaaatgttcacagaaaaaggtgaaggcatggagtcaaaaatgctggcgaaagtgattgctcaagcacaagcaaaagttgaagcacataactttgacggacgtaaaaatctgcttgaatttgatgatgttgcaaatgatcaacgccatgcaatttacgaacaacgtaatactttactggataatgaagatattgctgaaactattcaggtcattcgccaagatgtcttcaatcatgtcattgatgaatatgtcccaccgcactctttggaagaacagtgggatattcctgcattagaaacccgtttgaagcaagactttgctcttgatctgccgttaagtaaatggcttgaggaagacaatactttcaatgaagatgtattacgtgaacgtgttttagcagttgctatttctgaatataaacgcaaagaagaattggtaggtcaggaagctatgcgtaattttgagaaaggcgttatgttacaaactcttgatgaactatggaaagagcatttatcggctatggatcatctacgtcgaggtattcatttacgtggttatgcacaaaaagatccgaaacaagagtacaaaaaagaatctttccaaatgtttactgacatgttagatacattaaaactaagcgtcattactacattaagccgagtacaaattcgtactcaagatgaagtagaaaaagcggaacaggctcgtcaaaaaatagctgagcgtgaaaatgccgcaatgcaataccaaaataatgaaggaacatcatcacttcacgaaaaatcagaacataagataggacgcaacgaatcttgcccttgtggttccggaaaaaaatataagcattgccatggtagcaaagcaaaatattaattaatatggcggtggaaatttccaccgcactttttaggataaaaccatgataaaaccaacaatccaagttgccgctggcattattcgtaacgagtttggacaaatttatctaactcaacgactagagggacaggattttgctcaatcattagagttccccggtggaaaagtggatcaacatgaaacacctgaacaagcactggctcgtgaattagaagaagaaatcggtattcatgttctaagtgcggtgctttttgaacgtttttcttttgaatatccaactaagattattcaatttcatttttatcttgtcgaacaatggattggagaaccgtttggacgagagggtcaagaaggtatgtgggtcgatcaaaatgagcttgatgacagccaatttcctcctgccaattttaaacttattcaacgattactagcagaaaaatagcgataacaattatcttctcgttatatcagctttataatcgtatacaaacaagagggcatttacaaatttagcattttacgtccgcaataacattcaaaattcttttatctgatataggatatttagtgcctagttgttgagcaaataaactgactcttaattcctcgatcatataaggaatttctttaacttcactcgagtgcggtttagatttcggcagttttgctaaaagttgttggtacgcatgactaacctgttctactctgagcattgcagcacgatcacgattaatatcttgtgctaatttatcaatacgcttatcaattgcctgtaaataacgttgaatatcagacaaacgcccataacctgttttcgttacaaattccggataaataagtccattcatttgtgtttttatatcagcaaaagcaaatgccattgtaaaatccatttttcctttcaggcgttgattgatttcaaaagtcaaggtcaggattttttcaacttgctgtgcaatttccactgtaatctcattcagattttctcgaataaaatcacgcaatctctcaaaatcagtttcattccaaaccaaaccgccaaaatcagcaataagtttatccacggcacaagcaatgcaatcatcaattaaatctaaaactcgtccgaaaggcgtaaaatacaaacctaacttcgatttgttaggcaatttttcatgtaaatatttaatcggcgaaggcacatttaatagcaacaaacgacgtaatccttgctgcatagtaacttgctgttcaagctctgtttcaaatagcttaatgccgactgaatctttttcatcaacaatagcaggataagccttaatgctaaaaccttgttttttctgttcataaaattgcggtagccgagcgaaattccaaacatgaataccgctttgttcaataccactatctgcaacgcaggaaatacttttttgcactttatcttttaggctaaatttcaattgatctaaatcaaggctttcggcaattttgcctcccttttcatcaatgaccctaaaagtcattcttaagtgcggtggaatctgtgctaaattccattcttcaacttcaatctgaactccgctcatacgacgcaattcatgactaagcgtttctagcaaaggtttgtcggtttgcgttattcgacctaagaaagcactggcatagttaggtgcgggtacaaaattacggcgtaaagatttaggtaaagatttaattaaggcaataactaattcttggcgtaatcccggaatttgccaatcaaatcctttcatttcaacctgatttaatagtggcaatggaatatgcaccgtcacaccatctgcctctatacctggttcaaattgataagttaattttaattttaaattgtcttgataccaaaaattggggaaatctaatttgttgatattggcattgtcttcgttcatcagaaaagacttttcaaaattcaacaattcaggttcttgttgtgcttttttcttccaccaactatcaaaatgtttttgtgaaacaacatcggtaccaatccgttgatcatagaaatcaaataaagcacgctcatcaactaaaatatcccgacgacgtgttttatgttccaattcttcaatttccttaattaatttttgattggcaaaaaagaatttgtgtcgggtattccaatttccctctactaaagcggattgaataaaaatttctcggctggtaacagcatcaatagcaccataattagcaagcctattagttacaatggggataccataaagactgactttttcatttgcaatcacttgtcctcgagactttgaccatcgaggttctgaataactggatttaaccaaatgtttcgctaacggttcaatccattccggctcaatatctgccattattcttccccaaagtttagaggtttccactaattcggctgctacaacccatttaggttgttttttaaataaaacggaattggggaaaatagagaaatgtgcatttcttgcccctaaatattgctgtttttcattttctttgaatccaatatgggatagcaatccacttaaaagtgcggtgtgaatttgtgcatattcagcctcatgagaatttatgggcaaccccatttcacgcacggttaaacgaatttgatgataaatatcttgccattcacgaatacgtaaataatttaaatactcttttcgacacaagcgacgaaattgatttttgcttaaaattttctgttgctcttgaatgtaattccacaaatttaaataagctaaaaaatctgattttttatcagcaaaacgacgatgtttatcatccgcagattgttgtttttcttgcggtctttctcgaggatcttgaatagataaggcagcaacaataatcatgagttcatgtaaacaagaaaattgcaccgcacttaataacattttagccaaacgaggatcaacgggtaattgtgctaactgcttaccaatagcggtaagctggcgtttctctccttgcttgttttttttccattcaaatgcctgcaactcctccaagagcttcataccatcttggatatgacgtttatccggggcatcaacaaaaggaaaagcttctatatcatctaaacctaaagcggtcatttgcaaaataaccgatgccaaattggtacgaagaatttcaggatcggtaaatgccggacgattattaaaatcatcttccgaatacaaacgaatacaaatcccttcagacacacgcccgcaacgacctttacgctgattagcggaagcttgtgaaattggctcaatcggcaaacgttgtactttagtgcggtagctgtaacgtgagattctcgccgtgccgggatcaataacatattttatacccggtacagttaatgaagtttccgctacattagttgccaacacgatacgctttaaattactcgggtgaaaaattttattttgttcttgtgctgaaagacgagcaaagagcggtaagatttctgtatgttttaaatctaatttttgtaatgcttctgccgtatctctgatttcccgctctccatttaagaaaattaaaatatcaccgactttctctgcctgtagctcttctaccgcatttaaaataccttgtaactgatcttgatcttcttcctccacaattggacgataacgtacctctacagggtaagttctaccggaaacttctataatcggggcatgattaaaatgttgagagaagcgttctacatcaatcgtcgctgaagtaataattacttttaaatcaggacgctgaggcaacagctgttttagatatcctaaaataaagtcattgtttaagctacgttcatgtgcttcatcaataatgagcatatcatattgatttaaaaaacgatcagattgaatttctgccaataaaattccgtctgtcattaatttaatttgtgtttcatcgctgatttgatcactaaaacgaactttataacccacgactccaccgagttccatatttaattcttccgcaattcttgcagctacggaacgtgcagcaatgcgacgaggttgagtatgtcctatcactcccttctgcccaaaacccaattctaaacacatctttggtaattgagtggtttttcctgaaccggtttctccggcaataacgactacttggtgttcccgaataagtttctggatttcagcttttttttgattgaccggcaagttttgtggaaattcaattttttgtaccgcactttgtcgttgtaaaaaacgaaagtgtgcctgctgaatttgctgttcaatttccactatcaccttgttgatattcgtaggatttttaagttgattcatgcctttgatacgagcaaacaaacgacgccggtcaatcgacatcatgtcgttaagctgtgccaataatgtctgctgttgtgtgctaaaaacattttttttattattcttcattattcttatattcaaatttagtcaatcatgtaacgctaaaaattatttatcctgtttttccaataaacaaagacaaaatccctgcggcaattaacggtccaacaggaacaccccctaaaaatgcgacacccaaaatagtccctactaataaacctgtgagtagcgaaggttgcgtccccattaaatttacccctcgtcctccaaaccatgcaacaagcacgcctaccgccatggctaaaaacattttccaatgaataagtgcggtccaattcggcaactgaaccttgcctgaaacgatgggactaagtacgccaatagtgagaacaataataccaatatttacaccgtacctttccataaaagggatatattttgctaaaaaggtttgttgcattaaaagtaaaatagttgcggaaatggttatggagctattattgcctagtacaccaagcaaaataaggctgactaataataaagcaattgagttaaactgtaacgacattgaaatattcctaacggataattaattctcataaaacggtgctaattatagcaattttctacatgcttgcgactttttcgttatcaataaaaaagacattacagcaattatttaacaatattttaataattaaaaaacatctaatttacttaaataaaatttaaaaaataaacaatatattaaatataatttcaatttttagggtaaattttatttttttatattttaaaataattctatttgacctttcaattatttttgggtatatctaccccatcaaataaatttgtcatctttttaagtgaggatcttatgccccaaaaatactcaacgctaaaaaataacataaatatgttaggccactttttaggcgaaacaatcagcgatgcacagggtagtgatattcttgatttgattgaaaatattcgtgtattatctcgcgactctcgttccggtgatgaaaaagcacgggaaaaattattagatacgctttcgactatttccaatgaaaatattattccagtagctcgtgcttttagtcaatttttgaatttaaccaatatagcggaacaataccaaacaatctcacgaaaacacatagaccaagttgcctccgatcgttctttagaagcactctttgaacgcttaaaagcacaaaatgtaccggcagaaaaagtcatttcaacagtagaaaaattattaattgaattagttttaaccgcccatccgacagaagttacccgccgttctcttttacataaatatgtagaaattaaccgctgtttaagccgtttggaacacgatgatcttactcaatcagaaagcacaaaattaaaacgccgtttaatgcaattaattgcacttgcttggcatacaaatgaaatccgtacacaacgccctactcctgttgatgaagcaaaatgggggatagcggtaattgaaaacagcttatggaaagccgtgcctgatttttgtcgtcaattgaatctccatttagagaaaaattttggtgtacaacattcagtaaacttagcacctgtcaaattttcttcttggatagggggagatcgtgatggtaatccatttgttaccgcagagacaactcgccaagttttaatcatgaaccgctggaaagcggcagaattgtttttagcggatattcaagttttatcagaggaactttctgtagttcattgcactgaggaattccgtgccaaatacggtgatcatttagaaccctatcgtgtagtcgttaaaaatttgcgagcaaaactggtaaaaactgtcgcttattacggtgaaattttagaaaataaaccttcaaccatcaatacaaatgacattttgaccgatgatcaacaactttgggaaccgctttacgattgttatcaatctttacatcaatgcggtatgcgaattattgctaacggtatattgctggattgcttacgtcgtattcgttgctttggtctctctttgtctcatttggatattcgtcaagaaagccttcgtcatactaaggctctctctgaaattactcgttatattggtttaggcgactattcacaatggatggaagatgataaacaagcttttttaatccgtgaattaagctctcgtcgtcctttgctacctcgcaactggacgccttctccggaaacgcaagaaattttagaaacttgtcgagttattgcacaacaacctgaaggcgttatatcttgctatattatttctatggctcgcactgcctcagatgtgcttgcagttcacttattattaaaagaagctggcgtaacctattatttaccagtagttcctctttttgaaaccctagatgacctcaatgcttctaaagaagttatgactcaattatttaatgtaggctggtatcgtggtgtgatcaacaataaacaaatggtcatgattggttattccgatagtgcgaaagatgcaggtatgatggctgcttcttgggcacagtatcgagcacaagaacaactggtaaatctttgcgaaaaaatgggagtagaattaaccttgttccatggtcgaggtggtactattggacgtggaggtgcacctgctcatgccgcacttctatctcagccaccccgctcattgaaaaatggtctacgtgtaacagaacagggagaaatgatccgttttaaactgggtctacctgcagttgcagtaaatagctttgatctttatgccagtgcaattttagaagccaacctgcttccacctccggagcctaaagaaagctggcgtgcaattatgaatgaattatccgattcatcatgtaatatatatcgtagcgttgtacgtggagataaagattttgtaccttatttccgttccgccacacctgaacaagaattatctaagttacctctaggctctcgcccatccaaacgtaatccgaacggtggggtagaaagtttacgtgcaattccttggatcttcgcttggatgcaaaatcgcttaatgttaccggcttggttaggtgcaagtgcgtctattcgccaatcaattgaaaaaggcaataaagaaactattgaagaaatgtgtaaaaattggccgtttttctctacccgtatcggtatgttggaaatggtgttcagcaaaactgatacgtggttatctgagcattatgatctgaacttggttaaaaaagaattatggtatttaggtcaatctttgcgtgaacaactgcaagccgatattaaaactattctttctttatctcatgaagatgaattaatgtctgatttaccttggattgcagaatccattgccttacgtaatatctataccgatccgctcaacttactacaagtagaactgttgcgacgtttacgtgaaaaccctgaaaatccaaatcctgatgtggaacaagcattaatgattacgattacaggtatcgctgcaggtatgcgtaatactggttagtgatgaactcatcatacaaaagtgcggttaaaatcaccgcacttttttctacttctcacttttgtgctatgattatttcacttttacttatgagaaaatacgatgacagaccaaattaataaattagatcctgatacagcaattgatattgcttatgatatttttctcgaaatggcgggagaaaatcttgatcctgccgatattattttatttaacttacaatttgaagatcatggcggagttgaatttgttgaaacagccgatgactgggaacaagagattggcgttctcatcgatcctgatgaatacgctgaagtttgggttggcttggtcaatgaacaagacgaaatggatgatatttttgctaagtttttaatttcccacaaagaggaagaccgagaatatcacgttgtgtggaaaaaataatccaagctcaaaattgaggaaaatttgcagttcaatagcctcttcgtataattgctgaacttccagttttgctatttaatataaatcctagaatattactatttcaaataagaagagcggagaattccgctcttttagccttaaaatgcgttgtgattagttgaacatggcggaaatagattcttcattactaatacggcgaattgactctgccagcatacctgataatgttaatactcggactttacccaatgccttaatttccggtgtaaatggaatagtatcagttacaacaatttcatctaatgcttcattcgctagattttttgccgctgctccggagaatacggcatgagttgcataagcaaatacacgttttgctccccgctcttttaatgcttccgccgctttgcataatgttccgcccgtatcaatcatatcatcaactaaaatacaatcacgtccggcgacatctccaataatgtgcatgacttgggctacattggcttttggacgacgtttgtcaataatcgccatatctgtatcattcagcaattttgcgatagcacgggcacgaacgacaccgccaatatccggagaaacaacgatcggattttccaaatctgttttctttaacatgtcatgaataagcaccggtgaaccgaatacattatctaccggtacatcaaaaaatccttggatttgttcagcgtgcagatcacaagttaacacacgatctactcctacgctcgataggaaatctgccaccacttttgcagtaattggtacacgggctgagcgtacacgacgatcttgacgagcatatccaaaataaggaataactgcggtaatacgccccgccgatgcacgtcttagtgcgtcaaccataacgactaattccatgagattatcatttgtaggtgcacaggtagattgaataataaatacatcacaaccacgtacattttcattaatttgaacttgaatttctccgtcactgaaacgaccaacagttgcatcacctaaggaaatatataggcgttcggaaatttgttttgccagttcaggtgttgcattaccggcgaaaagtttaatgtcaggcatcgtaaatttaacctctggaatttgtattgttaggaagacaaagtgtttgtttttgttgcgataaatattcaatcatttgatgtaatggtgaaatatttgttccctgagcaacaaaaccaacgtatttttcaggtttatcaagaaatgcagattgtgccgcctgttcgttagcaaattcagcgaaaacacaagctccagttcctgttaatcttgccggtgcatattgtaacaaccagccaagggcttcttcaacctctgaataatgatttaaaacaactttttcgcaatcgttttcatattttgttgttaataattccgctaaaggtcgttttgaggtattgcgaggtaagttagaatctttaaatataatagctgtagaaatagatgtttcgggttttaatactaaaaaccatttttgtggcggttgacaaaaagtaagtttttcaccaacaccttcggcaaaagcggcttttccatatacaaaaacaggcacatcagcaccgagctgtaatcctatttcagcaagtgttgagagtgaaagttgtgtattccataaatagttgagtgcaacgagtgctgtggctgcatttgaggatcctccgccaacccctccgcctattggcaaaattttatctaaatgtaaatttgcccctaatgtacaccctgttttttgttgtaataatttagcggctcgatagattaaattatcctcgttttttagatgaggtatttcgggtgttaagattatttttccgtcagtgcgtatctcaatacttaaccaatcgccaaaatttaaaaattgaaataaggtttgcagttcatggtaaccgtcggagcgttgagaagttatatataaaaacaaatttatctttgcagggcaaggaaaacgtaatttttttccttgtatttgcgatgataaaagtgcggtcgaaaattgatagtttttcattaatatttccaattatctatcctaacttttaaggtctgctcactacttttcagaagaatatctttgggtaatggaatgctttgatctgttcgatagttgagatagtcagcactccaaacttcaccctcaactgaataagtaaagcttgctaataaatgatttatgccgacctgataatctgaattttcatctggttgaccttttagccagttccctatttgttgtaatggaatagagataccaatcatttcacgtagcaagttgttgatatcttttgttgaacgctgatttcctttatggtctgaaacagtaataccgaaaggtgaaacttcaaatttaagtattgaactgctgaaagctgatgaaagtaataaagaataggattgcggattgttatattgccaagtaaagcgagtggaaaaacgttgtttattgttaatataacccaattgtccttgagcttgatattgttttatttgcttaattttttgtaggtgttgctgccattttttatcatttttttctatatactgaataccttgcgggcgttcgctggcaatatctaaagtacaagcactcagcaatatcgttaaaataagtataaaaaaaggtttttgagatgttttcatgtgtcggactcgtaaaaatatcggatattttaaggtcttacataagattagtaaagatacaaacacttttgattttttgaccgcactttgatctgtttattaaaagatgctaatttaaatttatttgaagggtggcttacttcaatttttacaatgatctctttttaaggaaacacaatgaaaaaatcatttatctcaattgcggcgttagacttattgggagcggtttgggttggtacttcttggtataccggtaaagtagcagaacaggaatacaagacacacttagaacaggttaaatcgaaattacccgtaaatccgaacccgatagctcatctacatgctaagatcaatgatttacaatttaatggtcaatcttttactgatgaagatattaaacatgtaataatgaacagcggaattggggataaattaggtttacagtaaattgtaggttggctgatttttatactctcccaattttttctcaacaaaggggattatggagaaattttaaccttgaaactaattgcccaaagcaagttgtttggaaataactttatacataatggtgattatagttgctatttttttgaagacgaacaataatagtgtgccgataagcaagaacaaatgatttttgcgaggatattttttgataaactacgatatggttatttttccgtatcgtagttttgttttacttaaaaaggaagtgtacaacaatgaaacaaattccaatgactgtacgtggtgcggaacaattaagagaagaattagattttttgaaaaatgtgcgtcgtccggaaattatcaaggcaatttcagaagcacgtgaacatggcgatttaaaagaaaatgcggaatatcatgcagcacgtgaacagcaaggtttttgcgaagggcgtattcaagaaattgaaggtaaattagcaaattgccaaattattgatgtaacaaaattacctaataatggtaaagtgatttttggtgcaacggtcgttttgttaaatattgataccgacgaagaagtcacttaccgaatcgttggagatgatgaggcggatattaaatcgggtttaatttctgttaattcgcctattgctcgcggtttaatcggcaaggacgttgatgatactgttgtcattacaacacctggcggtaaagttgaatttgaaatcgttgaagtagaatataaataacataacaccttgataggaaaaaaatgggcttaatgcccattttatttgtttcagttattggcgaggtaactgaattttgggttcattacttggacgataaagtacaagaacatgccctatagcttgtaccgcactggcttgcgtttcacgtataattgcctcaataatcagctgttttgtttcacgttcagcaccagaaattttcactttgatcaattcgtggtgatttaatgcgttgtcaatttcagctaaaaccccttctgttaaaccatttgtgcccagcataaccaccggatttaaatgatgtgctaaaccttttaaaaattgtttttgttttgttgataatgtcattggttacccatcctacataattaaaagtgcggtcaatttgataacaatatttcaattgcctttatctcgaagattttaaccataaatccaaaaaataaaaagaaggaataattattttatagaatagttaaaacactttccggcggtcgtcctattttagctttatctccatttactacgattggacgttcgagcaatgcggaattttgcgagagtgcaatcaaaagttgttgttccgttagctcctgactattcaatcctaattgtaaataaagatcgtctttcgtacgcatcatctcccttacagacgtaattcccaatttttgagctaacgtttgcaactcttcaacgctgtaagtttgctgtagatataattcaacgtcaaaaagaatggattgttgttccaataaagccaatgtttcacgactttttgaacaacgtggattatgataaattttaaccgtcataaatgctcctttgctcagatacagttcaaatatgcaaaattttaccttataatcacccaaaatgctcattcgttaaggataaattatgattgaaatgttaaaaaattggtatcatcgtcgctttaccgatccgcaggcgatggcacttttcgctattttattctttggctttgtagcaatttattttttcaatagtttattggctcccctcctgattgcgattgttttagcttatttacttgaatatcccgttcgcttattacatgaaaaactgaaactgcccagaattttggcgacatctcttatactcggtggctttatagcaatcacatttgtcatgacctttattttgatcccggtactttgggcacaaaccatcaaactggtcagcgacttaccacacatgttcaatcaacttaacgaatggttactttctttaccggagaattatcctgaattagtagattatcaaatgatagatgcgttttttatttcatttaaaaataaaatattaggcttaggtgaatctgcacttaaactgtccattgcctccttgttaaatcttgttaccttaggaatttacgcgtttcttgtgccattaatggtatttttcctcctcaaagataaaacggaattaattaactatattacaaactttctgccaaagaaccgcactcttgcctcaaaagtttggcgagaaatgcaacaacaaattgccaattatattcgcggtaaattacttgagattttaatcatagctttagtcagttatgccatttttctattttttggtttgaattattcattgttactggcagttgccgtgggattatctgttttagtgccatacattggtgcagttttggtcactattcctgttgctttagttgccatgttccaattcggtgcaaccccaactttttggtatttaatggttgcttatgtgataagccaaatccttgacggaaatttactcgtgccatttttattttctgaagcagtgaatttacaccccctcactattattatcgccgttcttatttttgggggattatggggtttctggggaattttctttgcaattccattggcaacactagtcaaagccgttgtttcatcttggccgtcaacagaataaccgataaggaagagtttcattgaaagggctatttattaggattgttttagccatctgtttatcgctttgggcaatagatatggttttcccttggcaacaaatagtgagatcaaaacagaattaccatactacaattcaagagcgacaaaaattgattgtaggaacaatcaataatccggtgtcttattttatcggtacaaacggagaaacagggctagaatatgaattaagcaaggcttttgcaaattacttaaatgttgatttggaaatgtttcctctaaatagtgcggacgcattatttcaggctttagcacaaggtaaaatagacattgccgctgcaagtttattttatcaacaagatagaagtgaaaaattcaaactaggtccggcatatcacgctgcatcttggcaattgacttatcgcaaaggtgaacgtcgtcctatcacattagaaaatttatccggcaaattggttattccggctaattcggcactgaataatattctgctggcaaaaaaagaaaaatacccttctttaacatgggaaaccagtgaactaagccaagaggaactcttatttcaagttgctgaaggaaaaatagattacacaatcgctacctctactgaagtatcagttaatcagcaaattaaacctcaaattgcaattgcctttaatgtgactgatgagtttacagtacattggtacttatctgataagggggcttcagaattacaagccgcactattagacttcatgaactctgccattgaaaacggcttaattgctcgtattgaagaaaaatatttcaatcacctcaaccaatttgactatgttgatactcgctcctatttgaatgcaattgaaacagttttgcctaaatatgctcctttgtttgaaaaatataaaggtgatttagattggcatttattggcagccatatcttatcaagaatcccactggaatccggaagcaacctcaccaaccggagtacgcggtatgatgatgttgacaaaagcaactgcagatagaatgaatattactaatcgtctcgatcctgaacaaagcattaaagccggttccgaatatttacatcttctgctcaaacaaatgccggatactattttaaaagaagatcgtatttggtttgcacttgccgcttataacatgggattgggacatttattagatgttagacgcttaactaaacagctaggaggaaatccggataattggttagaggtgaaaaaaaatttacccttattagcacaaaaacgttattttacccatcttaaatatggctacgctcgaggctacgaagcgtttcaatatgtggaaaatattagaagatatatgaacagcataatgaattattatcggcttcaacaaaaccaacaagatcggtatgaaaatgaaaataatgatgtcatttcaacacaaacacaacaggaacaacgatgagaagaaaaacctttttaaaaaaaagtaaagtcacgctatatcgtaccgcacataaccgagcattaagaattaaacgcttaaaaaaacgtaaagcccaacaagcagcacgacatgcccagcaattcgtcatacaagaaatttgttgctgatttttcgtgctgtaaaatcatattctttagcatatggatataagaccaatcagataaaaaagcggaatttccaccgccctttttgctttacataacacaccctaccaaaaccggatcgttaaattctgttttacagcaacccttaattaacaaaacattcaaggcaagcgaaaagaaaaaagaaaaagaaaaagaaaaagaaaaagagaaaagcgaaataaaaaatgattgccttattaataaattttgtaataaaatctccgaaatttattactatctgcttgacaaacaaaaataacatgaatttacagcctacagcctacagcctaggctaacgcctttttataaaccttgcaaaataaattttaaaaagtttttaacttttcatcatacccaaatttccccttttaaaacccttagcgaaaatatcattcgtctttttctgctttgccttaaaaagcaaggcatcgccgatttatacctcattaatctacctaaaaaacaaaaagtttaatccattcacaaccataaaaaagtgaaaaaaaatcaacaaaataaattattaaataacccattttaaaagattaaagagagtaaaccatgaataagattttcaaaaccaaatacgatgtaacaacaggtcaatgtaaagccgtgtccgagttggcgagcaatcgccaaatagcaagtagctcggagaaaaagccaaagtgcggtgctaatttgaaaagaacgagcttgtcagaaaacttactgttcaacatgctgatcagcggtttagtgttgtttgcgtatcccgcttgggcaacagcggctcaaactcaagttaacaaagaaggagaaatcaaaatagatgctgataccttaaaaagtagtagcaacagtggtggtagcaataataatggtaaaggtaaaagcgacatcatcataggtaatgacgctgatgttgacaataagagtgtagctagcggtaataatggtctcggtcaacgggtagcacttggtaataaagcctatgtcgcaggcaatcaggcggtggggattggtggtgatgtattcgcccaaggctattcctccatcgccatcgggagcgatgatatcggcgaaacagctgatgaaaaacaaaaaaatggaagtggaaatgacaaatactccaaatacgccgtccccctacctaaagccatctggcagttgtttgtggatgagggagataattttaattcaaaaacgaaaaataactatgcggttttgcaaaatggtaatagtgacggtagcaacggcaaagccaaaaagagttcagagttttatagcaatgggaatggtagtggaaaaatcgacagaaataaagaccctgctaaatgggaagaagaatatgcaaaatttaataaagacgcatatgataaatatgtagaaggcacccaaaacggcggtagcagtaaccccaaaaacgtctactcccacacttgggcgaaagggcgtggggcgattgccatcggggcaaggtctatcgcctacggtgaccattctaacgccatgggaacgcttgccatcgcaaaaggaaactactcgtccgcctttggtacgggaaccatcgcttttgaagagggcggtatcgccgtggggaacaatgcgtacgtttatcgcgaacattccatcggggtgggaaataacgtccaagcaatacaaaaaggctcgatggtcttcggggtcaattcctacgccggtggtagcggttccttagcgttaggggaatatacctttgcgaatgtgactatgcatgatgagtttaatgggaaagcggaagctaagaaagtaacagaatttacaaaaataatggaggattataaaaataaatataatgcagagaatcctgacaaatcaccgttaacatttgctagttatacgcctgattcaccagacgaaaaaatgaatatagaagacctttatactgtgccaaattatgataccaaaacgatacagcatgttggaaaacaattttacagagccaaaacaaataaacaaccaggtacaggcgaagaaaaagccgaacaatccaaagacagcaaaggcacttataaccaaggcgggatagccatcgggtcgtattctgtcgcattgggggataacgccctcaccctcggcagacacgcctacgccaaagaagacagcacggttgccatcgggaacttcgcctttgcaaaagatgaaaacgccttcgccctcggaaaagccgcccgatccatgggtaaagattccttggcaatcggggtaaattcagaaatttggagtccagatgccgtggcaatcggcacaggctctaaagtggaaacaaacgccgatggcggtgtcgccattggacaaagtgcgacagtggcaatgggtgccggcgattctattgcgattggtaaaaattctaaggcgggagagaagaaacaagcctttaaaacccaagaagttaatgtgggtacaaaaggcttgatgtttgactggggcagtgcaggcacctcagaaaatgatcaagaggacaagaaaaaagccgtggtcagcgtaggaagtgcaggcagtgaacggattattaccaatgttgccgctggttctgttatgaacggttccactgatgcgattaacggcggacagttgtatagtgtgattgaaacattcggcaaactcggcacagatattcttggtgcggaagtatatgataaggataaggataagggtcagtacggatttaaggcttcaacgtttgacaaagtaaactatcatcgagaacagccacagggacaaggacagcaagaacaaaaagcacccacaacttttaaacaagccattgatgaaaccattactgcgataaataaaggtatgattttcaaagccggtaatgataatggcggtagtggtaatactacaacaaaacaacttggcgatactttagaatttaaaggagacgacaagtatatcaaggcgagtgtagatggtagtgctattaaatacagcgtagaagtagcaactagcatagatgacagttcaaccccatctagttcaggtggagcaggagcaggaacaacaggttccacggataaattagtaacagcaagtgcggtgaaaaattatgtcacgacaaaatttggtgcattaagttcaacgttgaatttagaaaccgatcaaccaactgatgacagtaaaaataaaggttcaatcaatttaaaaaccgatacattaaaaattactggcgatagtaatatcacgacttcatttgtgtctaatggtgaaaaaaaattaagtataaaacttagtgaaaatttaactaacatttcttccataggtaaaggtagtaatggtaccaaaatcacatttgatgatagcaaaaaggaaatcaaacttggatctgtatccgtaagtgtaaatgatcagcataaaatcgtaatcggtgaaggttccaaatcagaatcaaaccatacacttgcaatagggaataaagccataataggtcaaaatgcaaaaggctctatctctatagccagtctaacaaatggtgagcaggggaatatacaaaacgccgaatgggcggtgtctatcggtaataaaaacaacgtttcaggcggaaatgatattgtcgctttggggtcgaatattactataagcggtgaagagggtaagaataagtccgtagtggcgataggtaatggaacacaagtaaaaaatggtaaagaatccatcgctatcggcgtagcaggcaataccaaaatagacagtgcagaatgggcggttgctattggtaataacaccaaagtatctggcggaaacgacatactagcattgggttctaatatttcaataactggaagtaataatggaagtgtagtcgtactaggtaatggtgcaaaagctagtgccgcagaaaacagtgtggttataggtaaaggagcagaatcaaaagcccaaagtgcggtggttattggggaaggtgcaacggttgaaggtgatgctggcgattctgttgcattaggtaaaaattctaaggcgaaaactaaaaaacttgctccgagtggattagatggtaatgtcggaactaattcattaaaaatcagttggactgctggggtttctagagatacaaatgataaaaaatccgtattcagcattggagatgcaaatagcgaaagaataataaccaacgtcgccgcagggacagtagataatagttcaactgatgccatcaatggcggtcaattaaaaagcgtcattgatgtgtttggtaagttagcatttgatgttctcggagcggaaaaagaaacagagaaagaggcagataaacaaacagttaaagacggatttaaaaaatcaacatttactgctgttcaatataagagagacccacaaccacaaggacaaccacaaggacaaccacagcaacaagcaaaagtaccaatgacattcagagaagcgattaatgaaagcattgctgctattaacaagggcttgatattcaaaggtgatatgccaagtgcggtaacaaatggtactcaaaacacaccgcactatcttggttcgactattcagattgtgcgtttggcaacgcctgcgaacactggcacaacgactacacagccagctacaactacgccagccatcacggcgtatagtggggagaatttaatcacgcaatatagcaatactaatggcaacgccaaaatcgaaatcggttttaaaaatgcaccgacatttagcaaagtaatgcttgatgaagaacaaacatataatggcgtaaatggaaatagcggaagtacagattggaaaaaagaactcatcactaaaggctaccttgaacaagcgttagataagtttaagtttaaagtatctactggcgagggtgatgataagacttttgaaatcggtcgtggcgatacgttgaagtttacgagtggtcaaaatattcaattgactttagcgaagcaagatgggacaacgtctgctagtagtgcaacagctccaaccgctgcaccagcaccaacgcctgcaccagcagtggcaagcagttcgtcaagcgatgtaagttcaaatagcggtggttcaaatggtatggcttcgtcaggtggtgcaaatggcggtggttcaggcgatgcaagcatggctacgacgggaactgctccaagcacgccaaccagcacaacaagcgatacgagtacaccaaccgctactacaccaacaacggcagtgttaaacattgccacaactagcgatttaagcaatatcagctcgatttcctcaccgcctaaaggagcgaatgcaggtacaggcggaagcggaagtgcgggcggaaattcaggtactggttcaaatgaagaagtcgccaaacttaccttagaagccgagaaaggggcgactttccaagtgggtagcactggtgcgaaagtgaatatcaatgacaagggtatttcacttacgccacaaggagcaaatagcacaggaggatcaagtggagcagatccatctgactcaccatcaatcactattaaagcaggtgcaaaaccggcggatccaaaaagtttagattcacttgatcctaataacggaccttcaatagagttctcagccaagaaaacaagtgatggtaaaaccattggctcaggcaaaatcaccggtcttgctgatattaagtcagatgaaaaagacggcaccgttgcaaccaacaaaaattatgttgatggcaaagtggaagatctgaacaataaccgtccatttgatttttatttagacaaggaaaaagtcgtgaaagataaagatggaaatttccacaaagcagacaaacctactgaaaaactttctgccgatgatatgaaaaaagttgttatcaaagccgaaccaagcaccgcacctattgggattagcaatgtggcgagtgggttgggattgcctgcccctgaaaaagatgaggaagaaaagaaaaaggcacagcaaaaaaacactgagctaacaaaagctgttgaggaaacagtgaaagtaatcggtgataaagctaaagaactttcaactactgctcaaaaagtaacagatttaactttagcagccagcggtttggaaatggcgatgaatgcaatgcctgagggcgaagaaaaaatgaaacttcaaactcaattggaagaaaataagaaaaagctagaaaaagccaaagaagatctaggaaaagcaaaaactgctttaaccgaggcacaaaaaggcttaacaaaagccaatgctgactatgaagccaactacaagggttatgaaaaagtcgctgccttagtcagtgccgatagtaaagccgaattaaccaacgtagccacaatcggtgatttgcaggcggtagcgaaatcgggcttgaaatttaaaggcaatgatgacatggaaattcacacagcattaagcggtacttttgcgattaaaggtgaagaaggtgcgaatggcaataaatttaacagcgaccgcactgctgccggtaatatcaaagtggaaatgtctcaagatggcaaagggcttgaagtcaaactgtccgatcagttgaaaaatatgacctcttttgagacacgtgaagtggaggggagaaaatctacgctaaacagcaatggtttgatagtggtcaataaaggtgcagataacaaagtcaaatcagcaacatacggtgcggaagcgatggtgttgtcgaatcaagaaaacggcaataaagccgtggtgaccgctggcggtgtccattttgccactacccaagccccagcgacaggggctcgtgcggggacaggcgtgattacaggcttaaaagacctagacgcacgctcgacaggcgacatggcaaccaacaaaaactacgtggacgaaaaagttggttccgccgtcaatcgcttggataatgcgatcagtaccactaacagacgcttgcaggcgggtatcgctggagcattggctacaggaggattgccgataacggtgatgccaggtaaatctatgttggcagcgtcggctggctcgtataaggggcaaagtgcagtggcattaggctattctcgcatgagtgataacggcaagataatgctacgcctacaaggtacaagcacttcaacgggcgatgtcggcggttcggttggtgtaggctatcaatggtagggttctaaacgccagcaaaactcaccgcacttattgataagtgcggtgggtttggtagggatgattagttaaatctcaccaaaacagtgaacaatgcactgtcccaaatattaaactaatttattctcttatgtctcaggcttaagatctaattttgccatgagcaattgatcgccatcttcttcaggattgactgttaccaataatttgtcaccgtaaaaaatagaattggctcctgccataaaacacattgcctgcatttcttcagacattccttgacgaccggcagataaacgcacatagcttttcggcatggtaattcgagcaacggcaattgtccgcacaaattcagtccaatctaattcttgagcatcggcaagcggcgttccctccacttttaccagctgatttattggtacggattcaggctgaggatctaaatttgctagacttgcaattaaacccgcccgctctttgcgagtttcattcataccgacaataccgccacaacatacttttaaacctgctttcctgattttaccaagagtatttaatcgatcatcaaaatctcttgtgccgataatttctttataatgttcaggtgcggtatcaatgttgtgattatagtaatccaatcctgcctcttttaattcttccgccataccgtcttgtaataaaccgaaagtgccacaagtttccaaccccagatcttttaccgctttgataatttcagtaatttttccaatatctttcggcttcggtccacgccaagccgctcccatacaaaaacgccccgcaccacgagatttagctattttcgctttttcgacaatttcctccacacataataattgctgattttgtacgccggtatgataacgtgcagattgtggacaatagctacaatcctcagggcatccgcctgttttaatagacatcaatgtcgaaagctggatcgtttgtggattaaagtgctttcgatgtacctgagccgcttgatacacaagttctaaaaacggtgtttcaaataacgcctcaactttgcatacagaccaatattcaacgcaaggatgcggcgttaaagagggaatgttgatagttgtgattgtcatattcttttccttatataaagtgcggtcaatttcaacgaggaatttccctctctgttgcttgaccattttttatttcaactatgcgatcaattttatctatcacttcgctcagttgatgagtaaccaataataacgttaattgtttttctctgcagaacttatcaatcaatgtcaacatttcctgacgtaaatgaggatctaacgctgaaaaaggttcatcaagtaataaaatcggtttatctcgtaacaaacatctcgctagagcaactctctgtcgttgccctcccgacaattctttaggtaaacgtgataaaaaatccgttaaacctaccgcacttgctactttttccagttgtttgatttcttctttgctcaacttcaaatccgctcttaaaccgatagcaatattttgccataccgttaaatgagtaaataaattatgctcttgaaacaaaatggaaacagggcgttgatgtggtgcggtataagtatgattttcaccatttagccggatttccccttgcttaaccggctcaaatcctgcaattaagtttagcaatgtactttttcccgctccgctttcaccaataatagcaatcttttcgcctagacttatatgtaaatcaaagtgcagagaaatattgggataatcaaaaatagtgtttaatttaatcatctttttttattcgttcaattaatataaaaatacatgtacaaaaaacgagtaacagtaatgcagttactgcaccttcgtcagagcgataactacctaattgttgatataacaaataaggcaaggaactaaaatcctgattcccgaataaagctatggcagtaaaatcccctaaggaaatagcacaagccagtgcaaaagcatatttaaatgatgcgtttaaattatgccattcaattaaataaaatctattccaaccttgaatagccaaggattgcgatagtttttcgtaatgttgcatattgttgtacatcggtaactttagaacctgtaaaacaaaaggcatggcggttaagccattacatagtacgactaaagcaaataaatgatagtgggagaaatccatttcccttaagcgaataaataaacctactgaaataaccaagacagggatagccagcaccagcattccgctatttaaaatactctgagataaaaatgaataagacaaatagtgtaaacggcgtgccagtaataataatgaaacggaaaataacatcgctaaaatcgctgataaaggtgcaatagctaacgaataacctaaagcctgccaaagttgtgattgctgccaaatttgccataaactttgtgcttgaaaagcggagaaaacaatatttattaaaggcaagctgatgaacaataaaacgcaattgatataaaaaatttgccagatttgtaccgctcttgactgcttttctaaccaaatatttttactatgcaataacacttgtggcgatttttgccataggctacccaatgcaaacagcacacaacaaaaaattacttgtaacaacgcaaataaagccgacttcaccaaatcaaattcaaataaaacggcttggtaaatagccacttccaatgtagtgtatttgggaccgccgcctaaggtgagaacaatagaaaaactggtgaaacacagcataaaaatcaagccaaaaaccggtaataattgttggcgtaaatagggaaattcaatcaaacgaataaactgccaaccacgaagattcaattgtgatgccagttgcctttgctgagtaggaattgtttggaatgtttgcaaaaacattcttgctgctaaaggaatattaaaaaataaatgagcaattaaaataccgcttaaaccataaatatggggttgccacgttatgcctaaaaaggttgttaatttaaccagccagccgttatgtccataaactcctgtaataccaaaaattacaactaatgcaggcaacacaaaagttaacgaaaatagcttaagaatcaaagattttgctataaacctttgatagaaaaaggctcgagcgaataataagcccaaaaaaacagaaagtaaggaagataaggtagcctgtccaaaactaaataaaataacttgcttgatgtaatcatctcgtatcagttccgtcaatttataatcagtttcaacaataaaaataccgctcaataccagaccataaaatgaaacaataaataaccacactaccaatccacttaatgagctgattggtaatgtggaaaaataacgccatgcttttaacaaattacttcaccaaacttgcttgccattgattaatccatttttttagttgctcagcagaaatattggaactgtcaaacacatttgttttgagctgatactgttttaaggcatcataatgtggctcaatagggtcagaaatcacagataacatcacgttatttttaacgatatgtgtctgtgcttgcggtgaaatcaagtaatccataaataaatcaccacaggcattttctttgtttgctattttggctgctaattcaacttgtaaaacgccgccttcagcaaaatctgtcgcttggtactgatctttttgttcatttaataaatgataaagtggagaggtgctataacttaatactaaatccgcttcaccttttaaaaatgccccataactttccgtccaacctttaccgacagtaacggtatgtttagctaatgtctgccaagctcgatctacctcttgttgtggatacaccaaatttaaccaaatgattaatccccgccccacactgcttgttcgaggatcctgataaataactcgtaaatcctgacgttcaaccagttctcgcaaagagtgcggtggatttactaatttagttttatcataaataaaagcataatgcccaaaatcataaggtaagaaacgtcgatcttgccaagaaatcggtaaagaaagtctatttaaatcaactttatgctcactaaataattcagacttaattgcctcttgtagtaaatgattacttaagcctagtacaatatccgctttggttttcttaccttctaaacgcagacgattgaacaatacacctgaactgtcaaaggacacataatttacccgacattgcggatattgttgctcaaatccttgtttcacctttggacctgccccccaatcggaggaaaaacttttataagtataaacggttaagccttgtgccgatttcgcttccgcttgagcaaaagagcaaatagacatcgcagaaagtgcggtaaaaattagagtggttttgaagttcattacttttctcctgtttgaataaacacagcatgataagtaatattgacttgattggaaaaagaaaggagtaagaccattagtttcctacgtcagtattaactgtatcaggttcacgggtattatctcagctgttatcagcaccccgactaagtcggacaatagtctattatatttttgttgaaaataacaaggaattttctcttaatctttgacttaacttcaagaacttattatgtctaatgtaatgtacaatttttttatcaaacattttccggcacaatacaacgctacactttttcaagaaattcaaaaaaataaacataatcaaaaaactcaacttgagcaagttatggattatgtttatcagatttgtcgttttgcttgctcatatacaaaaaccgaacaccatcctcttattaaaagtaaaattagaattttaagcaaaacaaaaacgttcccaattagtaggcaggaagagtttcaagcctgtctaaaaagaaacgttttgaagttatgtcagattaaaagaaattatttaatcaattattttttttgtagttgaccacattaaagaaacgtcttccttcttgctttccagcgtagccacttttttgccaaaatgcattcttcaaccaattctcaaactgctgatgagttggaaatgtcatttcaccaaaattcggatcaaagaaagtaacttttgagccgtcaaccgccgcagatacagtgtgagatcctccctcaagattaatggagattttcttaacaccggcagtatcatcgcctgtatccaaaatcgcttttactaatgaggatacatcattttttgatacagttcctgatacttcatcacgacgaacaaaatctgctacttttttctctttcggaacaacaccctgctcttgcaaccaactatctgtcaatttgaattgttgagtcgcactaccgctattaataaactcagtttgaagttttttaatagaatcaatagtttcttttttcaagtgtccttttttaccaccttcataaagggtattaaagaaattctcgtcggttggattaacattttttgcaatccaatgtgcacaagttgattcacacacaccattttgtgtttcaatgtgttttacaatttccttgtaaacttctcctttagattgggcaaacttaaagcttacttctccaccaaactcttcaacggaagaacgtacagcatcaattttgcttttcactttcaaaggctgaaattgatcctgaatgcgttgcaataccgtgcgttgctgttccactaaatctttactgctcaccaaatcactaactggtttcgcttttgcctgttccgtttcagtaactgtttcagaaactgtcgcagatctaactgttccggaactcaaagcagccgaattttctaccgcactttctgtcaagtccgtagaagtgcggtcagttttttctaaattctgctcgttatcttccttgcttcctttttttgccaactcttttaaaaactcaactaccacttcactgctcgttgcggatttagttgatgctttcgtttgaggaataatctgcggttcaaactcatcactaaatttggtaaatgccggataacctgcatcaagtaaaattttatttactatgactctcgccatacgtccattaccttctgcaaatgggtgataagcaatcaatcgctgataaactaatgccccaaccacactcggctcaatcccttcatttttcgctcgattgataaaatcaaccgtttccgctaattgaatttttgccgcttcgggactagaaaataccgcattttctttggttaaattctcttttttataaagtaaacgaccttctccctcatccggacgtaatccgtgattaagattctcgatcatctgcactgtcaaaggtttgccttgactgttttgtaagaaatcctctattgctgtcttcaactgttctttcaactccggtgtacgttgaatggttttcgatgtcgcagctaaagcttctgtgatttcatttgtttttgttgaaagatcctctataacctttgttttcggtaacgttttcaccaaatcttgaatttctgaaaactcctcaacagaagggcggaatgtgattgccttattaatacgactttctactttcttagctccctcggtgagaatatcatcaaattcaggtaaatgagacatttgcttaactgtcgcttcaggaattgatttcttcgaaatctctcttgcttcatctaaaaatttctcatttttcaatacattactttcaaaattagcatttcgatcatcttctaaagaaattaatccttttaagttcaaattatcttccaaatcttgataattgactttattcgctgtctcatctcccgctacaggtttcgcaccgctcttacttccggtgaaaaattgtttcactcgttggaaaagtgtggttttttctttttctacacccgtagcaccctctgatttctctgccgcttttttatttcctccagcagcatcttttagttctgctggtacagatgacaacggtgcaacttcatttacagaagtctccactttcggaacagatggtaactgaccacctgctttaccttgttccggctgtttaatggtcaaactgtctgcggattgtgtgttttcgacttcactaacatctttagacttcaacgtaacaggcgaagtcgcttgtccgttttgattattcgcacctccctcttgcggagatgattttttacctaattcagtcaaaaactctttcacaacttccgcacttgttgctgatttagccgtagcttttgtttgcggaatgatctgcgtttcaaattcagaactgaatttagtaaacggcggataacctgcatcaagtaaaattttatttactacaactcgagccattcgaccattcccttctgcgaacggatggtacgcaattaatcgctgataaaccaaccccgctaaaacacttggttccacattttgcttgattgcttggttaataaagtccactgtttcatttaactgaatttttgatgcttgcggactggaaaataccgcattttctttagttaaattttcctttttgtaaagcaaacgatcgctaccttcatcaggacgtaatccatgatttaacttttcgatcatctctacagttaactctttgccctgactacttttcaaaaattcttcaatcgcaccttgaacttcttctttcaattttggattacgttgaattgtttttgacgtatctgctaaagcttctgtaatcgctaaagtttgtgcattgagatcatctaccgcacttcctttttgtatatttttcaccaatccctgaatttcattaaattcatcaacagacggcttgaaagttaaggcatcattgatacgtttctctactttcttcgctccctctgtcaatatttcatcaaactccggagaattacccatttgtttgattgtagcttcaggaatatatttcttagcaatctctcttgcttctgccaaaaattcaggatttttcaacacattttcttcaaaagaagaaccacgtttatcttctaacgccaataaatttttcagatttaagtcatcttccaaactatcataattcggcttagaaacagtttcctgttcagattttgcctctttagcttgtgatttattcgatttcgcaaagaagaaatcttttactttcgcaaaccaagatttatcctctgattttgtttttggcgatacgccctctgctccttctgattggagcttctgattaccgttattattgcgattactttcagccaccgcactttttggtgtacctaacgcaacggattgtccattttccgcaattgtctcattgcttattgaatcgctcaaatttgatggacgtgctggtaattccggtgctacatcatcttccactctcgtttttacaatcggattcgctgctgccgcttcatcaccttttgctttcgctctcgcaagcccttccggacttttatccaatgtcgcataaatcggctcgcttacctctgcttttgccggatttgcttgatcttctttagattttaaccgagcttttaattcattacccagttcatttacaaccgcattttccgccggtaatgcacgtttcggcgattgtggctcggaagaaaattccgatggaaacggttcaaattcttcaccgcccgactgaccacgtgccgatctcggctgtattgatggagaggtaatttcagcataatctccctctactgccgagcgttctgtacgcaccgctgcttgcgatggttcgtctaacggaattgtttcataatcactaacttgaccttttgcagctctcggttgtaacacctcagcaattgtcgcataaccatcttcaccctctgccgatgtgcgttttacaggcgatgttttttgcggtgccgtttcttgtggtagtggaatttcctcataatcgctacttccttgctgacgagatgctctcggttgtaacggcgaaacctcaccaattgtagcgtaatctccaccatctaccgcaactttaggtgtagcctccggtgttgccggtaaatcacgttttgctttattcgctctatttacaacatcattaatgtcggcataaatatgatctgccgtatcaacttcctgagttaaacggaaatttggaagtgccggcagaggatcattcgcactgcgagttttagaggtaatttccgaataaatttcattacctacttcttccactttgtttaacaaggttttcactgtcggtaattccggcaattgatcaccagccgctcttctcacactgccgtacagcggattatccaccatttcaaggttagaagatgcttttggtttggacaatacgctgtaaatacttccaatcgtatcataaacatgatctgccaaatccgcaccctgacttaaacgagttctaaactcatttggaagaggtggtaacggatcattcgcattgcgggttctagaagtaatttccgaataagtgccattacctgcttccgtgtcgctattcaacaagtttctcactgtcggtaattccggcaattgatcactcgcagatcttctcacactgtcgtacagcggattatccaccatttcaaggttagaagatgcctgcggtcgggacaaggtactgtaaatgctctcaatagtatctgctagaactttatttctcgtcccttcaccacctaaaaggctgtaaggactatcactttcaccacctaaggttctatttctaaccgcacttccattacctaaaagactgtaaggaccttcaccgatttgttcgtaaatatgttcctctgctgcttttgttcttcctaaaagactataaggacctgctacaatctcatcataaacatttgatctgatacgagaaatatctgaatttgcatcacctaccgtactgtaaggactatcactttcaccacctaaggttctatttctaaccgcacttccattacctaaaagactgtaaggaccttcaccgatttgttcgtaaatatgttcctctgcggcttttggttttcctaaaagactataaggacctgctacaatctcatcataaacatttgatctgatacgagaaatatctgaatttgcatcacctaccgtactgtaagtgctattactttcaccacctaaggttctatttctaaccgcacttccattacctaaaagactgtaaggaccttcaccgatttgctcgtaaatatgttcctctgctgcttttgttcttcctaaaagactataaggacctgccgcaatctcatcataaacatttgatctgatacgagaaatatctgaatttgcatcacctactgtgctgtaaagatcatcgctattgttacgtaaggttctacccttgttagcgttgctatcgcctaaaagatcgtaagcaccttcagcactcactttgtcataaactggctcatcgccagatactttcacttttcctaagaggctgtaaatatcatcgctaccgttaggcaattttcttcctttattggcattttgatcgcctaaagtgctgtaaccttcacctacctcatccaaagttcttagtttgcgtacgtcggcattagaaccgtaaagcggattatctaccatttctacaacatcttctgaagaaattctggttgtagtcggctgttcggcatcattatttactgctttgctaaacttagattgtaatttagattttgctttttcacccaactccactaagtctgcaacttcaaaattgaattgtgtacttgcatatacatcatctctcgttacggtcttagctttgcttagatcatcaacaatttcgcccgttacattattatctttaagattgattccggaaataaccgatttttgtaccgcatcgtaatgtttttgctccgcacgcccaccacgtacattaaatgaagatgcaccacgctcgttaatacctacagaaacgccgacagaaccaccatctttatgatgactatcattaagttgttggctcgtaacatttcctgaaacacggaagccactattttcatctttattgatgaaatgagccgctacaagatccaaatctttaatttgtccggtaattctgttcgcaacaatacctgcctgttgattaagaagttttctgttctcaacttcatgagtataacctgccccaaaacttccattaccttttacaagtgtggaactagaaagtgcggcacctgctgaagcactaaaatcaaaacctctataaagtctatcgaaggaatcttgttttgatacaatgttcgttttacctttgatatttaaatccaaatgatccgctttaatatttgagctaatcaaattaagatctttacctgctgcaatttttagatttttcgctctcaacaagctgttgttatgtgtaacagatttttctgtcgtgaaactttcattgccatcaacagaacccgatacgccaccattacaacctccgctcatcacgctacaacctgaatttataccaaatgcaaatttctgacgagattgtctttcagtactttctcttgttgtttcgccatcaagtatatcaacattacgtttggcttgaagcgttagcttgctgttagcatcgctttctacatttttcaactgtagatttccaccatgggctgaaagcgtaatattacctgcaatttttgtgcgaatgtcagaggtttccttaaccttatttgtttcgtaattacgctcaaatccaaacttagatgaaccgccgaccaattcgccggtaacaatatttgcaacatcgctaatgtgttgcaacgcaactgtaccatcttgcttaacgccacgttgtgcctctacaatttctttcgctacatggctaacagcatctgcaatagctgagtgtccttccgtttcaataccgaatttcaagactgaacgttcagaatcaagatgatattcatctttttgtttattcgatgtaatctcttttgcagaaagttcaaagccttcatcttctttaactttcttatatttgttgaataaatcattggcagatttttctgtcatcaaatcatcaacttcactttgagatagaactttaaatttaggttcctctttctgagctgcgttgtctgttgcatcaggtgcggcttttgccttagcctgttgctcagctttcgcttcatcttcctcgactgcttttcctgtgaacttatgcttgttaatatcaacaccaccgatttccgcttttttcaatacatgtaaaataccatgatcgacctgcaaatcgctgttggtgtgagttaatgatgtttctttttctctcgtttcgctgaaagaaccgcccaaagtaaaaccggtgccggtattagacgatgcaccaccaatatttgttttctctccattttggctatcacgttcatggcttacagtgaaccctgcaccgctaatatgaccggatgaatattcttgatccaagcgaatgtaacgttccgtctgttgagcatttcgacctgccttggtgttataatcaccttgtacaactccggtaacaacttttgccttgatcttactgccttcctgattcacatcattttttatagcgaaatgtacgtgatcaaattcggtatttgacccaacggaaattgctttttgagtgctttccttacgatagcccaatatctcgcctttcttagagaaaattctacctttttcaacggaatgctcagttctgtgagtatctgtcgtattaaaattacgagctttcacaaaacctgttttacctttaatatccgatccttttgaattaatatccgaatcttcatctgcttcaaggtgtaaatgtccctctgttctaattgatgcacgttgaacttcaacatcgccgtttccattaacaaaagagcgggcggtattatcaattcctttgtgtccaactaaacgagtgctttcctcacttaaaatatcacctctatttttaattttattttcggcttcaatatcaatatttttaccggaaatcgtaccgctgtttagcacatctcttgttttcaaattaatttcattagcacgaataagtgcatcaccaagccctttgaatttttcagcatctcttaatgttttatttgcaaaataaacttgcggtaatagaacctctttattgttgatattggctttaacataccaaacaatgtcttgtttaagttgattttgttgttcttttgttagtgcttccccaactttcaaacctaactctttagattcaaaataagagttatctattaattttttaaccaactgtgcatcatttacttgatatttcaatgccaaatggttatctactttcttctcaatagattttgtaattaactgatgttctaaatagttatcaccaattaccgctactttcttaccggcatcggtagatgaacctactttatttaagaaatatttagatccaaaatattcatcttggttaatatactgcaatttcgttctgtaaagcggatcggtttccactttaggacgtgtatcatctacctcttttaagaattggtttttcgaaagtgcttcttcaatttgatgatctttcgccagctcttttctgtattcttcaagacgtttttcttcttcaattttcgcttttgcatccgcttgtttttgctgttcttgtttttgcttcgctaaagcctcttgctgtttttcctcgttaatcttgccttgtaactccttctctttcgcaagcttttctttttcttgctgatcaagctgttgcaactctgcttgtttttcaagatcgtttttcgcttgacgtttttcttcctctttataacctgtttctaggtcactttgtagttgttcatttttggtttttgcttgaagagcttcagcttgacgtttctgctgagctttttctttatattcattgaatttttggcgtaatttatcttgtacttcactaggcaaagtatcaaagcgatctcttgtttctagtcttgattcggttttataatccggttcgtctggttcatcgggatctcgctcccaatcatcagatacctctcgaatatatgttttttcaccaatttcacccaacaacttatctaagaattttccattctctgataattcgttttcattcaataaatcaggttcttctcctgtatgaggttttaatagaaattcatcttcctcatcaatttcaatatttttatcaactgttttatctaactgtacgctgttatccacaaaaagatttggaatagataacaaatctgacaatgcggataaatcaacattgctattattcagattttcttttctattcacttccgatctaaactctactttacttaagtcgaatttatgttgtcctacagtgattcgttcactttcagaaaatcctccggttgaaccattttttaactcatctattttgccattaattctttgagcaagaattttggctttatcagttggacgataatcaaaatgtgcatcttgtttttctttaaattctttccagcgttgtgataatttcttgtggtcttcatttttccaatttgccccaaagaccaaagtcattgctttttggaaagtcggcgatttaatctcttctaataaatgtacagcttgcgagttatccgcataataagaactggaatttgttattggttgctcagaaaataaaccgtcaaaaagctcctcaagagaattgaattttctctctgcttgccctgaaagtgcggataaaaagagacgggctctcggctgataattaaatgtaatatcttgtttttgtttgaaaaattcagtcaacaaattggcttggtaagccttcatattatttacaactttcgcattttgggcttcgaaagtgtttttaacattaattacaccatggttagtcaatgttgcatcttgttgattatctcctttcttaccttcgaatttgaaattcccttccgcacggatcaaacctgctttttcgactttcacttctgctttttcaaattctattggattaatccataaacgatagtcgttattatgccaaccatgacttgcaatatcagaacggcgataacgatttaacaccgaataaggtgattttttagtaatgctaccggatagtttaacatcattaatcagttcattagcttttacagtaagatcgctcttagcaaaaatattacccaagttgtaaacggtattttctgcatcgagttccattttaccctcagaatgcaatagagaatccgctccattaataatatttccctcagtttctttattatttcctttagcagataaagtcagttgttcacgagcacccaaaatccctttttcattatagatactcccctgtttagcattaatcgtcagcgtttttccgctggctaataatccgttgttaacaacattacctgccgcattaatggtaagtcttgcagtagtttgtagttcatcattttcgctaataaccacattttgagcatcaatagtcaactcatctttcgcttttataaacttgttacccttgctgacaaaacttgtattatctttaaaagttaatttagctttagatttactttcaatggtaccggtattttcaaagccaacatctaaatcagcaacggtttcttctttaacgtccgccttgcgtttattgtctttatttacagaaacagtaactgtcttacctttggttgtaatatcaagattgtcttccgcataaatttcttttttattgactaatttatcggtatcaatttttactttatttccgtaaatacgcccttggttagtcaatgtttgagatttaagctcaagatccgttgcaacgacttttgtctcgtcatccaacacaagagatttttttgcttccacttttacttttttagaggctaacttccctttaccttttaacttagcttcctctgtggctgatgcctctttattattttttaacttaacatcatctgcggttattgtgatagacttatccgccgtaatctcatttgctatagtaattcttttggcgttatttaatgaaatctcatttttggcttgtagtttatcacctaaatcaatatcccctttattgctttcaattttaatatcattttcagacaaaataataccgtcgtgttttacacccgcaccttgctccgttacgatcaatttaatgcttttaccgtgcatcgcacctgtacttgccccagtaatggcgacttcttctttatcggaaggctgactggtattactatctttttgtacttctaattttgtcttaccatcattctcaatgttatatttgattttacctttcccagcaatgaaggtaatttctgtttccgatgttttgttcttttctttctctttatttccaatcgtacctttttgttcaattttcttcgcaacaatatctaagtaaggtaaattatccgttgcaaacccgttgacatctattgttactgttccttgtgtaacatcaaattccatcttgttaggatcaataagtttactcgtagtagcaacaaaacgtcccgcattaatagtttgcactccatttaggttaataccatgttggttagcaataaccaaatcggcttttgtacctaaaatttccaacgcccctttaatttgactaagttctgaacccgttacctgatttaaaataactttcgcttctttgtctgctagattcttattaccttccagataacctactaattcagaacgttgttgatctttattatttttaaaaaccgctccgtttggaatattaaatttttggaaacggttatctgaaattcctttatcattcggtttcgcaatatcgataacaatgacgttattttctgttttgtatagcttagtaggatggttattttcagttgtacctgcacctactcctatattttgattcttagtctctaactggataccgtcattaccattttgaatttcagttagcttaggcgttttctccgcttttgccgcttcctctgccgactgtgcaaaattcggtgctgctaccatacttaacagcaatacagaaacgcttttccaatttaagcacaacgcagaagataccggatttaaaaaggtttttacggataaacatacgttggataagcggtagtcttcaatggatccctgccggtcttcctcgtctgttttttctgacacaacaacagaatcagatgaaccactatctacagctgatgtaatacattctgctacaggaactaaacaacctcttgtcttgctgaaaataagcttataacaattcttattcataataccttcctctaaactaaaaaatcaaaacgaaaccgaacctgtgaaataaaaaaccgacttcttgttactttcctcaaaagttcccactccattaataggcttagcataagtcaatgataatgcaagtgattttatttgagctttcacaccgaatgcaaaccccgcaaacgtatctacaacatggtgcggtcgttttgcatgaacttttcctatatcaatacccaaaaaagggttaatgtaagataaataactcttttgagggtaaaaagggatcgtaactgtttgagaaatatagaaaccacgatcacctgagcctgccccacctttgaatcctcttaccgtatattcatctccaattgagaactggttctctccatataagctatcaaatccatattgtgcacctaaacgaaattgataactcattcctcgattaaaaaaaacaaacggtctctgccagttaatactgcctgaaaccaatcttaatgttttgtctctatgtgaattatatgcagaatgatttgcattaaaccaccgcagtccattggaataagacagatcactataaagtttgccatgccccaaattggtcacataagataatcctatattcaatttgttattgtgatatttccctatgcgaatatcaccaaagtagctaagacgccttttaaactcaagttctccatataaagataaaatcatgtctttattacgcaataatgtgtgcgataacttaaatgacgcttgctttgtttccccactggatccgtgagtatgaattcctctcaactgtttcttataaccggaatatgataacttaatatccaaagtcgaaaatgagaaaggttgagtataagacaaggaataattttgttgccgatttgcttgacgatccttataaatacgataacccgttgaaaaactccaacggtcattcgttcctaacagatcactccatgagatgcttaatgttgcctgatttcgaccttcggcattacttccttcaccggaattattcaggcttaaactaacctgcggataagaagtgcggtgcctctcaatgctcaaatttgacatacttttctcattcgctgcaatcacattcacctttgctgtcttatttcccgtatttagaatttcgatcagctgatccacgtcgtaaatacgaagtacctttccttttaaattaggcaaaacaaatagcattgctttatctttgaacaaagaagcctgctgttcttccactaaaatatcatttacttttccccaaagtacgacaaattccacttcaccgtttttgatctttgaagattttaaaccaatagcactggttacataaccggcattgtacaatacttgtgttagctcttttgtcaacgcaaacaccgtttttgccgataatggttggtttaaataatgttttgttacttcatcaaaatccaaaaagatctcttccccaccaaaatcaatggtgatcttcgtgatcgtttgtacatcttttgctgattttaattgctcaactatctgttcttgatttggtcgattatcttccaaaaaccgctgtgctttctcgaaattttgctcaactttttcaaattgttgttgattttttaaatgcaataactcttgaaccaaaggcttagcctctttcgctgcttctcttgcttgcgtaaccaaaggatcttcttgtgcttgcacaactaaaggtgcaacaacaaaagaaactagtaaacagcatgaaaataggatatttatcttgttatatttatattttggcataaaacgccgtccttccactttaattggaacaaattatactatacgctatttagacaactggtaataccagtataaatcattcttagcaatttcatcgtgtctttttcataatttttcataaaaaaatacccctttcctgtgctaaaaagaaaattgattatactatagtttttatactattgaatggaatgaattacgcagtaattactttcttatttttatctttgttttatcataactgtcattttcattaaataatactaatttcctctttaaatctctccttttttcgagtagattaagagttttcctcaaaaaattaagtaaccataaggaagaacattatgttattaactaacccagtagtaatttccattattgtgttactcgccttaagtcttatgcgaattaatgttgttatgggattagttatctcagcattagttgccgggctatgtagcgatttaaccattaatgaaacaataaaagcgttcacaggcggtttaggcgggggggctgaagttgcaatgaactatgcaattttaggtgcttttgctattgccatctctaaatcaggtattaccgatctacttgcttttaaagtaattaaacgcttaggtaaatcgccaacaggtaattcgatggctggatttaaatactttattcttgccatactagtgttattctcaatttcttcgcaaaacttattacctgtacacatcgcatttattccaattgttattcctccgctccttgcaattttcaataaactaaaagttgatcgtcgtgcggttgcttgtgtcttgacatttggattgactgcaacctatatgcttctccccgtcggtttcggtaaaatttttattgatagtgttttagtgaaaaatattaatcaagtaggtgcttcactcggcttaaaaaccagtgtagcagaagtctctttggcaatggcaattccggttatcggtatggttatcggtttattaaccgcagttttcgtcacttatcgtaaacctcgagagtatgtttcaggcggtttaaatgctacaactgaagaaatcgaaaagcacattgcaaatattaagcctttccatgtgattgtaagtgcggtcgcaattgtactcactttcgctttacaactgataaccagttcaacaattatcgctggtcttgtcggtctcattattttcgcagtatttggtatttttaaactaaaagaaagcaatgatattttccaacaaggcttaaaattaatggcaatgatcggtttcgtaatgattgccgcttcgggctttgctgcggtaattaatgcaactggcggtgtaacaattttggtggataatttcagccaaggcttgggtgcagaaaataaaggtttagctgcatttcttatgttgcttgtaggtctatttattaccatgggaatcggttcatccttttcaactgtaccaattattacatctatttatgtaccgctttgtctttcctttggattctcaccgttggcaactgttgcaattatcggtgtttctgccgcactgggcgatgctggctcacctgcctcagactcaactttaggtccgacatccggcttaaatatggacggtaaacatgatcatatttgggattctgttgtaccaacattcatccactacaatattccgctcattctttttggttggattgcggcaatgttcctttaataacttactttgagtgcctatggcatggcactcaaattttttaacttatgcaacaatctcctgttattatcttacttaaacaaaaagttgacgagtttttctctcgttattctcatataccttccaagcaaaaaatctatgccaaatttgaccgcactttatttagccaagactttgagagtttgtcgttttacctgaaagaagttcgtcaatgtttaactcaattagaaaaaatcaatgatgataatgtacaaaaatatactttttatagtgaaaaattaaaaggacaatgtaaggctctctcagaggcgttatcacaaacgaatgctaaaacaaacatcaaatttcagcataacgatacaaatctgcaatctgtacaagagcggcgggaaaaacaaagaattgcactgaataaacttcctccaagggaacgtttaagcaaatattatgaagcattacaggctttaaacacaaaattagaacgacaacgagattgctttgaagaggctacattattacaggataagcaaacctatagccaacaaatcgcaattacacaacaacgtaaacaacggtgttctgaggctattgaacaactggaagaatatttggctttattagatacaacctcagagaaataacgaaaatataacgaacatatttcacaagtatgcactatttttgtttaaattcttgcattaatcgcttgatctgccgatcattctttttaaatgctcgacaataaggacaaaataataaatgaatattaattgcacatttttgatagaacgctaattttttttcattactcaaagaaatcaattcagtaatttctttacaatttttcatctattttttccctccaaaccaatttttagataaacatgcctgtaactgaagtctagctcgatacaacaatacatgtaaattagacgtagaaatctcacattcctgacaaatttgttcgctatccaattccaaatactctcgcatcataaaaatgcgagcttgctgagctggtaaccgatttaaacaagcatcaaaaataacccaaaactcctctttataagtagcactttgaatatctgaccattcattaggttcaaaatggtttaaatcccaatgtcctttatcgttaaaaaacgcatttggtgcatcttcttcacagatttcagaaatattaatcattcgattacgactatgaattaagtcaataattttattttttaaaatggcaaatatccaagtttttaatgcagatttcccctcaaaagtgcggatattttttaaagcatttgttaatgcctcttgtaccacatcttcagctaaatcaaaatccttcagttgcaaaactgcaaatttgaccatttgtaagcgaacttcttcaagatccagttgagaaatatgttttatttcactcacaatcgttctccttgacaaaataatgtaagatttttcatcattctctgactatacaaattatacgtcaataatataggatttaagaatgaaaaaacttacctcaaacgatgttacacctgaagaaattttctaccaacgtcgtaaaattattaaagccttcggattaagtgcggtggcaactgcattaccaacgtttagttttgcacaagaaagtagcgacttgaaagcacttgaatataaaaaatcaacagaatctactttaattttaacccccgaaaataaagtaaccggctacaacaatttctatgaattcggtgtagataaaggttctcctgcacactatgccaaaaaatttcaagtaaacccatggaaactggaaattggaggagaagtcgaaaatccttttacgctcaactatgatcagcttttcactcaatttcccttagaagaacgtatttatcgtttccgttgtgttgaggcttgggcaatggtagtaccttggattggttttgaactcaataaattattagaaaaagccaaaccgacaagtaaagcaaaatatgtggtatttcatactttgtatgatcccgagcaaatgccggggcagaaaaatcacttctttggaggcggtattcattatccttatgttgaggctcttaccctcgccgaagcaatgcactctctcacattaatgtcagtaggtttatatggaaaagcattagcaccgcaaaatggggcaccgattcgcttggttgtaccttggaaatatggctttaaaagtattaaatctattgtcaaaattaccctatcggaaacacgccctcgcactacgtgggaaagtcttgctcccaatgaatacggcttttatgccaatgtaaaccctaaagtggatcaccctcgctggtctcaagcctccgaacgggtcattggtgccggcggattattaagagtgaaacgacaacctacactcatgtttaatggatatgaacgagaagtggcacatttatacaaaggattggatttaaggatcaattactaatgttggcattattacgtattattattcacttgagctgtttagctccattaatatggctttttttcgtacttttttcaggaaatgaaaccgcacttggtgccgatccgatcaaagaaattgaacatttcttaggctatacagctattttgattttctgtgctatgtttttactcagtatcctattgcaactattgaataaaaaccaataccaaattttacgccgtcctcttggtttatgggcatttgtattggcattattgcacgttgccagctatcttttcttggaattaggatttgatttctcattattcataaatgaaattataactcgtccttatctgattttaggcggtattgcttttttaattttgtcggtaatggcaataacatcattgcctaaaataaaacaatggctcggtaagcgttggttccaagtacatcagcttgcttatatagcaattatctgtgcggcaatccattattattggtcatcaaaaagtgtaactttagcaccgattgtggtaagcctagcagtggttgggatcgttatttggaaatatagcggaaaatatctcttaacatttttgcataaaaaatagacattttattgtataaaactctcctgattttcaccgcacttttccgctaattgaatgatcatttcacacaaaaagcgacaactaagtgtcgctttctacctttaagcaaaccatcctgcttgatgggcaataaataataatgtgaacgcagttaaatacactaaaccgattatagaaagccaaaataacccgcctcttatccgatgttcgccctttaatacaagcgaaagatttaaccacgcaaaaataggcgttgaaacaaaagaagcgatcatggcaaattctaacattggaccgacagcattattgaagtagaaaataatcgctaatccggaaagtgcggcaaataatatcgctaaatttaatgttcttaaactactttgttttttatttaaaattaaacgtaaacattccacatttgagcgagaatatccatcaattaccgtaattgttgtaccaaacatacacataaaagcaataaatgcaataagtgcttttgcccattcaccaatcgttgaagcatacatattaatcaattgtgcaatatattttccaccaaccatttgaaccgtttcacctgaaccaaattggactagtgcacccagtgcaagaaatacaatggctaaaattgcagtaccaatataaccgacattaaaatcccaaatgccgtcctcataagatatttttgaaatacggcgtttagcgactacccacattgaattgattgcagaaatttcaattggtgcaggcatccagcccatcaatgcaacaataaaagcaagtgcacttagactccatggatttggggcaatataatcttgcgaagcaacgccattaataccattacgcattaatgcaataattacagcagttaatgttgtcaatgttaatgcaatcataatgagtttagataaactatctagcaaacgatattgcccaaataacaaaataaataagctaacgccaataacaatcagactcaatgtaggaaccggaacagaaatcggcaatacaaaagttaaaatcgccgcacaaagcaagcctactgcggcagtattaataaccgttgaaaaaacatttaataagaaaaatacccatagataagatttccctttttggcgataaccttcaagtaacgtgttaccgctatctaaagtatattgcacaccaaaacgaaaaaatggatatttaaataaattcgctaaaagaataataatggctaattgccaaccataaatagcacctgcctgtgtcgacgcaataatatgcgaaccgccaacagccgctgaagccattaaaataccaggacccagtgcacttaatttttttgcccaaaaagattgatttacttgttgattttctttcataaaaattcctactaaccatctaacgaattaaaattctaaaatatttaaatataaaaacaagagaaaaataaaaaataaaattctaataaagaagatttataaacaaaaaataattatataaatccaaaatatttaactttactagattttaatgctattttttaaaaaataaaaagaaataaactctagaaattaagaagttagcaaacaaataaaaaacatataaaaagtaaaagcaaagaacacaatttctgtaacaagatgaaaaaccgaaaaataagatggctggggtactaggattcgaacctaggaatgccgagatcaaaacccggtgccttaccgcttggcgataccccaatagatattctaaatctgagtcaattaagaagtgattaggatagtatggctggggtactaggattcgaacctaggaatgccgagatcaaaacccggtgccttaccgcttggcgataccccacctactaaagatttgcaagctaatgaatggtgcgggacgagggacttgaacccacacacctcgcggcgccagaacctaaatctggtgcgtctaccaatttcgccagtcccgcaaacatggtggctatgacgggattcgaacctgtgaccccaacattatgagtgttgtgctctaaccaactgagctacatagccatatcatttgcattaccctcatcggctttgcggggctaattatgctgatatataccttactcgtcaactattttttaatgttttttttgatttcagtgctgttcgcatatagattatacaattcagataaaaagcatcttatactgtttttaataaccgtttatgattgatgtcgaataatccaacaattatgaatttgtttattccgttcaaaatctaaaggtaacgttttagcagaaatttctaccgcacttaactctaattcttgcaaaccgtctatatccattttaaaacctcgtttattattggaaaaaacgatagttccatttgttcgtaggatacgctttagatttgccattaacttaatatgatcacgttgaacatcccagctatcttccattcttttagaattagaaaatgtgggaggatcaacaaaaatcaaatcgaattgacgatcacatttattcaaccactgcaaacaatctgcttgaattagtttatgctgtttaccttcaatatcatttaacaacaaattctgttctgcccaatttaaataagtatttgacatatctaccgtggttgttgattttgccaaccccaacgcagcatgaaccgttgcagatcctgtataagcaaataagttaagaaaatctttccctacagccatttctcccagcattttacgggtcaaacgatgatctaaaaataaccctgtatccaaataatcagttaaatttacccataattttgcaccatattcatgcacataaaaatactctcccttattagcgagtttttcatattgactggtgcctttttgtttttgacgtacttttaaaattaatttattcgtttcaatacctgttaccgataaaatagcacttacagcatccaataaacgctgacgagctttattttcatcaacatttttaggtgccgcatattcttgtactataatatgatccgcatagcgatcaaccgccaaattgtattcaggtaaatcggcatcatataaacgataagcatccagtttttgttgattagcccatttatcaattttcttgatatttttacgtaaacgattagcgaaatcttgtgcaacttgtgtattttccgatacaaaagtcaatgttttttcttgcgaattttcaaccgcactttctacctgtttacgaacagcaatatggtaatttttttggacacaatctaaaggaccgttttttgccttaaattgacgatacgcacgtaaacgtaaacaatccagcaatgcaggttctccactaaaaattgaaacgttccaatctgcaaactctgtttttaattgacgaccgaatacagaatataaagcaattaaagccggagtagtgcctaatctttcaccataaggcggattacaaatcactgttcctatttcttgttcagttggatttttcaatcctgcaacatcaccttgttgccatttaatgagatgtgagacccctgcattttgagcatttttctgtgctttcttcaatactcgatgatccaaatcaaagccccaaaagtgcggtgttaattttcgattaaatgcctgctctgcaagctcaactgcctcttgctttactttttcccatacaacttgattatgacctttccaaaaatcaaatccccaatgtaaacgatgtaattgtggtgctatctgagcttccatttgtgctgcttcaatcaataaagtgccggaaccgcacataggatcaacaagaggtgtccctttttcccaactggaacgtaaaacaattgcagcagctaatgtttctcttaacggtgctttccctgtatcttcacgataacctcgcagatgcaacgcctctccgctcaaatcgagagatacaactaactcatcttgatttaaataggcatgaatacgaatatcgggatactctttatccacatttggacgtgtttttccatgacgctcaaaataatctacaataccatctttaacacgcattgcaccgaactgagtatggcgaatttctctattagtaccgttaaaatctaccaaaaaagtaactcgttcatcaaaatgagtcaaccaattttgtccaacaatagcagaatataaatctaaatcactataaatttttgttgtaataagcggtaacaaaatacgagaactcaatcttgaccataataaaatgcgatactgcgtttcatcattcgcaataaagtgaactccaccttgtacaactcgacattcttgagcaccaagatccgttaattcaacttttaaaagttcttcaaaaccacgtgacgtagtagcaaaaagttgtttcattctatctctctataaagtaaaaattgggcgaaagcccaattaacattaatgattaaattgcgtgctatgtagctgtttataagcaccatttaaggctaataactcttgatgagaacctctctctttgatttcaccctgctcaatcactaatatttcatctgctttctcaatagttgataagcggtgtgcaataaccaataccgttctatctttctgcaaagtttccaaagcggcttggattgcacgttccgactctgtatctaaagcagaagttgcttcatctaaaatcaaaaccggcgaatctcgtaataaggctcgagcaatagccaaacgctgacgctgtccgcctgataaactcgcaccgttctcaccaatcacggtatccaaaccattttctaatttttcgataaactccatagcataagccgcttcagccgcttcaataatttgctcacgagtacatttctctgtaactgcataagcaatattgttagcaatagtatcgttaaacaaatgaacttgctgtgaaacaaccgcacaatgttcacgtaaatttgccaaagtataatcttggatattcaccccgtctaaagtaattttaccttgttcaacatcataaaaacgagtaaccaagttagctatagtcgatttacctgaaccggatcgtcccaccaatgcaacggttttaccttgcggaatagtgaaagaaatattattcaatgccggatgttcttttccactgtaactgaaagtaacattttcaaaccgcacttcccctttaactgtatctacaacatgtttccctgtatccttttcagtttcgagatctaataatgcaaataaagtctgacaagccgccattccacgctgaaattgtgcatttacgttagttaaagattttagtggtcgcatcatagcaagcattgatgaaaaaacgacagtaaatgaacccgcactgagattttgtgtcatgatttccggtagtgttgccaaaaataaaacggcagcaagtgcaaatgaggctattatttgtacaaccggatcggaaattgcactagctaccataactttcatgcctctacgacgcatattattacttacttgatcaaaacgctcttcttcaattttttgtccgccaaaagctaaaacaactttatggccttttaacatttgttctactgaagaggttaaatctcccatggagttttgtaaattttttcccaattcacgaaatttttttgacactatacgaatgataatcgcgataattggaccaataataaaaagcaccaaagccaattgccagctggtataaaacatgaccgtgagtaaagctatgatgtaagccccctcacgtacaattgtaactagcgaacctgatgaagaatttgctacttgttcactatcataaacaatacgtgacagtaacctccctaccgaattctgatcaaaaaaagtaacgggcatatacattaaatgcctaaacaatctacgacgcatcaccatcacaactttacccgaaacccaagctagacaataagttgaaatgaaattggtgaccccacgaacaaatattaacaaaaccaccacaatagccattattctcaagagcgaattgtcaactttaccaaaaccttcatccaacaccggttttaacatttggatgagtgccgcatcagctaaagcattaaataccaatgctgcagcagaagcaattaagcctaatttaaaaggtgctattgttggccatagccgtttaaatgtttgtaatgtagaaagatctttatcttgcatattcatacttctatcgtaaaaaaattgagtggcattatacatttatttaaattacaagccaattaatcctctataccaagggctaaactctgtccttgcggtttgaatttgaatatcttttcctttaaatgttaaacggatttggccggaaatggccgtattatagaccgcactttcaaccgcatttaagcgtttgacgacatcttgatgcggaaatccccacggattccaacgtccactggaaattaaagcaattttaggctgaatatgctgtagtaatttctcaccggttgacgttttactaccatgatgtccgacctgtaacacatcaatcttacccaagtcagacaaaattttatattcagtcgccacatcagcatctcctgttaatagtactttatgctgtccatctgaaattatcagcacacaagaatccggattattggctctcatcacaattttacttggcgataaagcttcaatatataacccttgccaatgccatatttttcctttttgacaagcaatatgcggtctattttctggagaattctcgtacttttttaatgagggactaataaactcagcattcggataagcttggaaaatatcttttactccacctgcatgatcattatcatcatgacttaatataactttatcaagaataataccctgtcttcttagataaggaataatctcaatttttgccatactaccatttttccagcttgctcccgtatcatacaaaattccatgttgattttttaccaataaacttgccaatccttgaccaacatctagagtatcaaattgccattgtgtgttttttaatcgcccttgttcatatagcgaaaaaaaccacagacataaaaaaataacaaacatagctgaactgaccaccataccatattgatattttttatgtgaaaaaccgtccgaaaaattcaaccgtatagggtaaaaacttttttttctaacttttctcaataaagataaatcatcgtcggttgaacacttaataatccatttacagcataaggtgaagagcaaagctaatatagctgaaataaaatagctttctgcaagagaaatattgatccactgatttggtaacagctttaacaattgattgatccatatagcaagctgatcagctatattccagctatttaacgcaccttccgtcagtacagcaaaaagaataagtggaactaacaaaaaactgaacaaaggcaacaataataaattagcccaaaatccatttaaggcgataccattaaaaattaagagttggataggtgtaaaaaaccacaaaagcccaaattgcaaatgaaaaagaccgataaaataccgcacttttttcaaggaagattgtgccaaaggcttttctttccataaaaataaatttagcggtatccattgataccacatgatcaaacaacctaccgctccgattgatagccaaaaactggctgacaataacataaatggattaagtatcagtaaaacacaaataacccgcaaaaatagttgccaaacactataggaaactcgacatatacgacacaaacaaactataaataaagcgacaatcgcacgaaaagtaggaattgaaaatcccgctaattctgcataacagaatgctaaaaaaatccctaatattaaaggaaaataaggttcaatataacgagtagggaataataattgaatagctcgccctaatgtaaaaccgatgaacatagctaaaccaatatgcaaccctgaaattgcaattaaatgtgcggtattggtttgttgataaagttgccataattccttgtctaaccatgctctttcaccaaaacccaatgcaagcaataaaccttgtgaaactaaattggaagtttgttgtaaagcttgattcagtcgagtagctcgccaagaaaaatcctcaccaattttcaccgcactttttactgtggcataagctgtaatttcttttgctaaataccaggtttgacgatcaaatcctcctatatttaatcgagaagaaatcggacgaatgtgcatatttacttgccaaatttcaccaacttgaacctcttgctcagtacgccaatttaaataaattcgctgtgttggcaaagatgaggtgaattttccttctgcgatcactgcttgatagtctttctgctgaataatttcagctattttaacgttagtttgtacttttttaggtaagcgggtaatatgctcactttgttccaacaagtttaatgcttgataatgaaaaaatcccaacccaagaacaaaaatgaaaaatagctttagaacacagcgaaaaaatactgctttaacaccaatatatcctaacccaagaacaagacataagatcaatatccattgccaattcaataaaaaaatacgaggcgtaattagcaatgtcattgcactcactaaaataacaaaaaggtaatgatcaaggttgaatttcattgataaattgaagattaattaattcttaatctacaatatgaaaaaaatacccataaaaaccaagtcagataaacttatcttggaatacaaatcacaaaatcaacaaaataatagaaaaaaatgaagagttaacataaatttatttgcttatttgagcaacttctgatatttatagtgcctttaaaatcagctgttccattttttggagtttttgaacaatcataaccagtttgcaaagtgctttcttaagttacaatcaattgtaagccacagaatgaataattattaggagatttaaatgtctaagtcatctttaagtttattagtgctcgccggcgttgacccttataaagaaaaaaaaggcgaagaatatatgaacgatgagcaacgttctcatttcagaaaaattttgcaggcttggcaaacacaaattcaggaagagacatctcgtactgtagcacatatgcaagatgaagcttcgaactttccggatcctgctgatcgtgcaacacaggaagaagaatttagtttggagttacgtgcgagagatcgtgaacgtaaattaatgaaaaaaattgaacatacattgaaaaaattagaaacagacgatttcggttattgtgattcctgtggtgtagaaatcggtattcgtcgcttagaagctcgcccgacagcagatctttgtattgattgtaaaacgttagctgaaattcgtgaaaaacaaatgatcggttaaccaattgatcaaatttggataatgtaaaaataaattttggaaacgttttttgatagttggtttgttagcttaaaagaaattttagaacataaatcaattgttagtgttaatacaaataaagtgcggtcttctctgccgcacttttgaatttttataaaactacaagatattaaaaaaggggtttattattttaaaatttattcaaaatctgttaagaaaaaaaaataaagtagctaaattaccaagctcaaatttgcctctaacagtttctacttcaaaacataaaactatctctcaggaaatgcgaactgagtcgccttttattgcaacaaaacagcgatcgatacacaaaaatcaacacaataaatatgttgtcaaggcgtctcaatacggaattatgccacgtatgatcagtcgtaatgcactgtcagttgtagaaaaattacatcgtaatggttatgaagcttatattgttggcggttgtttaagagatttattattaggcaaaaagccaaaagattttgatgttgcaactaatgctaaacctgagcaagttcaagctatctttcaacgacaatgtcgtttagtggggcgtcgtttccgtttagctcatattatgtttggacgtgatattattgaagtggcaacattccgtgcagcacacacggacaatcataatgaacgccaggcaaaacaaaataatgccggtatgctattgcgtgacaatgtttatggaactattgaacaagatgccgaacgccgtgattttaccgtcaatgccttttattataatccgcaaaataatacattacgtgattatttcaacggcattgaagacctcaaagccggaaagttacgtttaattggcgatccagttaaacgctaccaagaagatcctgtacgcatgcttcgttctattcgctttatggcaaaactggatatgtttttggataagcctagccaagaacctatcaaaaaaatggctcatttattaaaaaatattcctccggcaagactttttgacgaaagtgtaaaacttttacaagcgggttatggtataaaaacttatcagttgttacgtgaatacggattgtttgatcaattatttcccacgcttacatcttatttcaccgataaagcggatagctttgcagaaaaaatgattattaccgctcttacctctacagatgaaagagttgccgataacttaccaattaatcctgccttcttgtttgccgctttcttctggtatccgctaagagagaaagttgaaacactcaaaaatgaaggtagtttcaataatcatgatgcttatgctctagcaagtaatgatattttagatgctttttgtaccgcacttgccgcaccacgtcgtcatacaactgtcatccgagatatttggtttctacagcttcaactgcttaaacgcaccggttctgctccgatgcgagtcatggaacatgccaaatttagggcggcatttgatctcctcgttatgcgtgcacaaatagaggggggtgaggcaattgaattggcaacttggtggcatgaatatcaacttagtaaccaagatcaacgtgaaagtttaataaaagaacaacaacgccttaatccgaaaccgaagaagaaattttatcgttcaaaaaaacatcggaaatctacgctatcatcatgaagactgtttatatcgctttaggaagtaaccttgatacgcctatacaacaactaaatctggcactaggttcattagctcaactcaaaagttgtaaattaagtgcggtaagttctttttatcaaagtaaacctcttggtccacaagatcaaccggattacgtgaatgcggttgcttgtttaaaaaccgaattagatcccatagccctattggatcaattacaacatatagaaaaccaacaaggacgagtgcggttacgtcgttggggtgaacgtactttagatttagatattttgttatatggcaatgaaattatccaaaatgaacgcttaacaattcctcattacgatatgaaaaatcgtgaatttgttatcattcctctttatgaaattgcaccacatctcattttacctcatggcgaaaaattagcggatataatgctcaatttcactcatcatcaaatgcaaaaattataaaatttaaggcaaatatcataatatttgccttatttgctgaactaattttcaacttaaacattgttgaattttttttcgaaggatttgacgtcgttgactataaattacaataagttttccactcaccattcactgcggtaccaatcacgttaaattgattatcaaagacagttaagtttgcaatcttgcccacttcaatcgaacctaatctatcatcaacgccgattgcacgagccggatataaattacacatacgtaaagtttcatctagaggaacttcaacatatttcaccatattttctaccgactctatcatagtgaccgccgcaccgcctaatgtaccattagcgtcatagcattttccatctcgcacatagattgtttttccaacaaattgaaaagattcaatattggctccggcggcggctgtcgcatcagtcacaatacaaagtttatcgcctttcaactttttatccagtttgatattttcaaaactcacatgtaaaccatcggcaataataccgctataaatatcactatctaatactgcaccaacgacacccattgcacgtccagaactaattggcgacatagcattatgtaaatgtgttgcaaaacctgctcctagttgaatagccttttttgcaacttcatagcttgcattgctgtgtcctaaagaaaccaagatcccattttttacaaactcaggaatatgttttgcggttggattttctgctgctaaagtaattttagtaatgacatccgcattatcacataagaaagatttcatctcgggcgtaatttctcgaatatattcatcacgatgcacacctttacgctcaacacttagataaggtccttctaaatgcaaacctaatgcttgattttgatatttttccaaataatctcgcatgacttgcaccgcacttttcatcccttcatcaggtgaagtgataaaagtcggaagatagcttgtcgtaccggagcgtaaattcgtttcttgcataatctctaatgtgcggacactaatatcttcattaaacattacgcccccacaaccatttaactgcaaatcaataaaaccagcggttaaattattaccttttaaatcaatacgttgaatttcattacatagctgttcttcggaaacaatggctgaaattttatcgttttcaaccactactgcatgtccgtacagcacttcttttgccgtatagatcacacaatttataaaggcatatttcattttttcgtccttttaatcaagcacgctatgaatagcacgttgttccagttcagtaaaatacttaaccgtttttacttttaattcttgtgttgccggttcatcacaaacaaaaatagcatgacgatgtaattgcaatgcactaattgtccaaaaatgattaacatttccttcaacaccagcttgtaaagccaaggctttattatgtcctgttaccaacaacataacttcttccgcatctaataaagttgcaactccaatagtaagtgcatatttaggcactttagttacatcattatcaaaaaaacgagaattggcaattaatgtatcttctgttaatgttttaattcgagtacgagaggcaagagaagatgccggctcattaaaggcaatatgcccatcaacccctacaccgcccataaataagttaatcttaccgtaagatttaattttctcttcataacggcgacattcttcatcatgatcatctgtattcccatctaaaatattaatattttgtggctgaatatcgatgtgattaaaaaaattattatacataaaagaatgataactttcaggatgttctttaggtagacctacatactcatccatattaaaagttacaacatatttaaaactcacttcctccgcttgatacagtttaattaactctttatatgtctgtaatggcgttcctcccgttggtaaacctagtacaaacggacgttctgcagtaggagcgaatgtattaatacggtcaacaatatattttgcagcccatttactgacttgttgtgctgtttttaatggaattaaacgcataaaatcaccttaattatttcgatattgtcatgtacaaaatgaagttttatttcagaaatagaataataaataaaattatacactaaatctaataataattagcctatttcttaaaatagtgatctcaatcacagataaataaccgctacatttggattgttccacattgcgaaacatattattaagcaacattaatggtgtcggtataaaggataatataaaccttttgatttaccatttttccaacgcttgttgatcggattctcgatgttcaatccaacgtgtaccttggcaagtttgttcctttttccaaaaaggggctttgctttttaaataatccataatgaattcattagcctgataagcatcacctcgatgagctgtgctgacacccactaagacaatttcatcacccgtatttaacaaaccgacacgatgcacaactgcaactcgataaagttgccaacgtttttttgcctcgacaacaatttcctgcaaggctttccctgtcattgccggataatgttccaaatataaaccggaaaccgaatcgcccaaattcatctctcttactttaccgataaaaataaccgcagcacctacgctatgaggctcggttagccattgataaatcgcattttgatcaaaattttgctcttgaacggaaattttaatatctggcatttatcctcccgtaacaggtgggaaaaatgcaatttcatctccggaacgaaccgcactttccaacggtttaagcgtttgattaatcgcaaccaatagcttccctttctctaaagctaatgcccatttatcacctttttggctgagatgttgacgtaactgctctgctgttgcaaattccgctttaacctctaattcatcaacaccgattaattctctcgtttgtgcaaaaaataatacttttaacatctttataaattcacttcttgtctattcagcaataaaatgccctgattttccaccgctcttttcaagtaatctaacctgttcaataacaatgtctttttgtactgccttgcacatatcataaatggtcaatgcagcaatactggcggcggttaatgcttccatttcaacgccggtttttccacttaatttacatatactttcaacacgaacactacttatttcaggaagtgcggtcaaatttacttcaacttttgataataacaatggatggcacaacggaataagttcccaagtacgttttgccgcttgaattccggctatacgtgcagtagcaaacacatcacctttatgatgctgccctgaaaggatcatgttcaatgttgtcggcaacattcgaacgaatgcttccgctcttgcttcacgaacagtatcttgtttagcagatacgtctaccatgttcgcttcaccttgatgattgatatgcgtaaatgttgtcatattttccttttatcctccaatactcgccaaatgatttcgaataccgctatcgccaatatgtaaaaaatgatgttctcttttactttgcaatgctgtaaaaattcgactttttaattggttctgctgctcatcaaattgcaataaatctcgtagatcaattccttcttcaccaaataaacacaagtgtaattttccctttgccgaaactcttagacggttacaacttgtgcaaaaatttttttcataaggcatgatcaatccaatttcgcccttataatcaggatgtgcaaatacctttgccggtccatctgcacgttcttttttctgtatgctccacccttctcttataagtttttccgctaaaatttgacctgataaatggtattgatgaaaaaattgagccatttcgccggtttgcatcaattcaataaatcgcatttgaataggacgctctttgacccacattaaaaattgatcaaactccctatcattgagagatttcattaacactgaattcactttaattttttcataaccaatttcaaaagcacggtcaattcctcgcataatatcgtgaaatttatcaacgccggtaatcgcatgaaacattttaggatcaaggctatccacgctcacattgattgcactgattcccgcttttttccaatcctcaacttgtctagccattttgtagccattagtcgtcaatgcaatattttttattgtttcaatagcacgaatattttcaacaatggacaggaaatctttacgaagagttggctcaccaccggtaatacgaactttttctgtacctaattgtgcaaaggcattcaccaatcgtttaatttcaaccagattcagaaaactgggttttgtgctttccgctcgatagccatgaggtaaacaatagttacaacgaaaattacacatatccgtgacagacaagcgtaaataatagtatttacgttgaaacgcatcaataagatgattttcaataacattatgaatagaaatagatctttgcattagacacctttttaaataagaaaggataagtcgtttccaatattatccctgagcaattatatttgctggcattgtttccttatttttcaacttaggtaaacaagctcggagttatgcgataacgctcgtattttaaagaaatttaactcattagcctagtcttaaatgaatgaaattaaaaaattgtaatttagtacataaatttaagtgataaacattcaccttaagcatttcaatctttataataggtgaaattttatggagagatattatggcaacaattaaagatgtggcaaaaatggcgggagtatccacaacaacggtctcccatgtcatcaataaaacacgttttgttgcaaaagaaactgaacaacaagttttgcaagcaataaaaaacctcaactactcaccaagtgcggttgccaggagtttaaaagtcaatacaacaaaatctataggaatgattgttacaacttgtgaaactccctattttgcagaaattattcattccgtggaagagctttgttatcgacaaggttattctctatttctatgcaacacgcaaaataatccggagaaaatcaaaaaccatctcgacatgctggctaaaaaacgtgttgacggcttactcgttatgtgtgctgaatatactcaaaactctcttaatctccttgccgcattcgaagatttgccgatggttgtcatggattggggaccatttaatgaaaatacggatcttatccaagataacagtttctccggtggatatattgcgacaaaatatctgattgataatggtcataaagatattgcgattatttccggagaattaaaaaaaactaccgcagtaatgcgttatcagggatttgaaaaagcaatgcaagaagcaaatctggctatcaatcctgactggatcatggagggcttctttgaaccggaagatggctatgaatgtatgaataaaattcttgtgcaagataaactgccgactgcagtcttttgttgtaacgatgttatggcattgggtgcaatttcagcaattggagaaaaaagtttgaaagtgcctgatgatatttcagttattggttatgataatattcatgcctcacgcttcttttctccccctttaacaacgatacatcaatcaaaatctcgtttaggtgtacaggcaattaacctattgtttaaacggattagtgaaaaggggaaagaacatgaaattatagaaatttatcctgagcttgttattcgcaaatcagtgaaaacgctataaaatctatcttaaaataaatctccataatatttttgtaggtatttatttttttatctattatctaattgaatatgttcaaacaattttttcaccgcattattatctcttaaacgttcagcttgctcgaccaatgttcgagttaagtgcggtgagaaatattgaataaaatcgtacatataatttcttaaaaaaataccatgtttaaacgctatttgtgtcatactcgatctaaataaatggcttgcatcaagtgcaactaaatcattgtcagcctcagtgtgtgccattgatgccattattcctacgcctaaccctaaacggacataggttttgataacatcggcatctgtcgctgtgaaaacaatgttaggcaataaccccgcactattaaaagcatagtctaaatcagatccccctgtaaaaccaaaggtataagtcactagaggatattgaccaagtgcttcaattgtcaatttcttacattgagccaaaggatgttccggtttgacaattactgagcgattccacatataacaaggcaataaaacaacgtcatcaaaaagatattgtgcttctgttgtaattgcaaaatcaacctcaccgaataaaagagcgtcataaatttgcgtaggagaaccttgatgaatatgtaaacttacttccggatattgtttagaaaaacgtctaatgacggaaggtaacatataacgagcctgcgtatttgttgtcgcaatacgtaaaactccacaatttggacgagtatattcattggcaattgctttaatattttgtgttttaactaataattcccttgccacggcgacaattcttgcccctgccggtgttaggcctttaatatgtttaccattgcgttcaaaaatctctaaacccaactcatcttctaacaacctaacttgtttactgataccgggctgagaagtaaacaatgcgttagccgcatcagtaacattcatattttgattaacaatttcaacaatataacgaaattgctgaattttcatagcaatacctaaaatctcaatgagaaaaaaggtgcgtcaaaacacaccttcgataaaaaatttattgtggataacgagctgcgacttcagataatagaggttgcaactctccctgttgaaacatttctagcattatgtcacaaccaccaattaattctccctctacccacaattgcggaaaagtaggccaattagcataattcggtaatgccgctcgaatatctggatgttgtaaaatatcaacataaccaaaagggacattacaattaattaatacttcaaccgctcttgcagaaaatccacacgacgggaatttaggcgatcctttcatataaataagaattggattctcactgatttgttttttaattttgtctaaagtttccataatatctcttataaggtaaattcgggctgaattgtagcataatacaataaagccctaaataaatatttagggcttataaaatctactaaaggataacgatattatttgctacctttcactgagatttcaacacgacgatcttctgctaaacaggcgatcagtgctttacggcctttaaccgaatcacatttcataccagtcaccggatttgcttcaccgtaacctaccgcactaatggcatcttgagcaacacctttagagactaaataatttgctacagtatccgcacgacgttgtgataattttaagtttgacgcatcagaaccgatacggtctgtataaccagccacagaaacttgtgcggtttttaattgtgcgatttcaccataaacaccgtccaatgtttgttgagcttcaggttttaatgtatctttagcgaaggcaaaattcacatctgaatttaagctgaacactttgtttactacttcaggtgccataaccggtttttgaccgaaacggtaagataagccaagtgttaccgcaccgatacttggtgtatagtcgaaacgtttaccatcattcttacgtgctttaccaacgcctttaacccattgatattccaaacgtaatgccaattccggtaaagaaggtaggctgtattcaacacccgctgcgaaaaccggagaaacttttaaagtgtttttcacaccgtctgctgaattttcgaaatttttaacattaagataattagaacgaattaacgccgcacctacacgaccgtaaatatccaagccttctaatacagggtagcttgcttttaagcctaattgcatcccttgagcggtatgtttagcttcttttttatctttacggcctttcgcttgaccgaaatactcagaacccaactctacagcaacatgatcggtaatttggtaaccaccaaaaataccataagctactgaattacgaactgttcctttcttttctgtagaattttcaaattgattaagaccgtcatggaaagatgcccaaccggctttcgcaccggcatagaacgtatttgcttgaggtgccgcttgtacagaagcgacaaaacctgcgatagataatgcaataattgtttttttcatttgaatttcctctatattaattatcaagaaattaagcactacatgtattccgaagatttaaacatctctaggaattaaggtgggattttaacctaattttacaaaaaagataaattttttctctgatttatcttattaaagcctaaaatttaagcagattttccattttttttgctttaactaagaattcttttctttcatgacttgccatttgattacttgttcccggtaatttcactgttaacgggttaacaggtctaccgttaatatgaaattcgtaatgtaaatgagcaccggttgaacgtccggtatttcccgataatgctatacgttgtcctctttttaccgattgccctggtttgactaatgagcgacttaaatgcatatagactgtctgatattctttgccatgtctaatcatcatataacgtccggcaccgttagcctgataagcgactttctctactactccatctgccggagcgatgatagtcgtgcctacaggtacagcaaaatcaacccctttgtgcggtcgtatttttcctgtaacgggatgacggcgagcaagattaaaaggagaagacaccctagcttgacgtaataaaggataacgtgcgaaacctttccctaaagtttctccctgacgactataatagcgtccattatttgcttggattgcgtaataactttttccaccggacataatatgtatggcttcgaccttgccttgcccagtcaatttattatccagatactctctcgaaactaaaacggcaaacttatcccctttttttaacttattaagacttacctgccactgaagtgcggtagttaattgagcaatttgtttactgctcaagcccaaggctttcaaactggcataaaatgatccttctatctgtccttttagaacctcttctttccaaacacttttcttttctaaaatttgacgtttaaactgagattcattaactcgctcataaatacgttcttcacgttcggaaacaagccaatttaaatattccaaatttccatcattatccaatatccaataaatttgttggccagctttcaggttttttaattctggataactcgccatcatttgacgacttatttcctcatccaaccctgaatgttccagtacatctttcaatttatcgccacgtacaacagtatgagaaaattgatctttaatccgcattgcctgatccgctgcatctaataaactatttaacgcatctttggcattatcaggcaatgatgatatttcattatccaaattaacttgatccgtttcatcatccaaaccgtctaaatcatcataagacaattcactgttatttttttcatttgcaattggcatatcaacggatgtaggcttctgagaagaaacatcgtttctcaagaacaaccctatacccattaaaataaataaaatagctacaaaaaaaacggcaacttttatgtagaatttctttttgcgtctatctctagctaatttaatgtgctgcaccattctaataacaactctataaaatttcagaacttcaataagaccgagaattgtactaaaaattcatttcatttcataaaaaaaattatacacccgcataatttatagacataaataattactacaccttgttaaaataaaaaaaataagctatttttctacttcaattttacctcagacatttgtttattatgcaaattcactctctaaaatatccattaatcgaattaaaaggcgttaatgtaacattcgcacaaaagactattctaagcgatattaatttaacgatttatcccaattccattatgaccattgtaggaccgaatggaggcggaaaatcaacattactcaaagtactattaaaactgttacccgccacaagcggtgaagttatttatagcaaaaatgtcgtcattggttatgttccacaaaacatttatttggacaaaagtttgcctattaccgtagaaaaatttttatctttaagaaaagggacgcataaacaagatataaaagatgctttaacattactttccattgaacatttacgtttgaacgctatgcaaaaactgtccggcggtgaaatgcaacgtgttttgctagctagggctattttgaataagcctaatttacttgtattggatgaacctactcaaggagtagatataacaggacaagcagaactttatcaactgataaagcaaactcaacaacaactcaattgtgccattctcatggtttcccatgatctacatcttgtcatggcagacacaaacgaagttctttgcgttaatcaacacatctgctgtgcaggctctcctgaggcagtatccaatgatccggtttttattcgtttctttggcaatcaattcgcaaaaaatatcgctttctatactcatcaccataatcataaacataatattcatggtgatatttgttgtggtcaagatttccggtctacacaatgtaaacacaaaataaattaaggaataaaaatgcttgaaattctctttcccgcttggctaaccggaatattactctcattaattaccgcacctttaggctctttcgttgtttggaggaagatggcttatttcggtgatacattggcacactctgccttacttggtgttaccttaggcatttttttacacatcaatccatatgttgctattctaatattaaccgtattattagcgatcttaatggtttggctggaaagtaatacgcaatactccatagataccttgttaggtattattgcacatagttgcttatctcttggtgtcgttaccgttgctttactgcaaaatgttcgtgtagatttaatggcttacttgtttggagatttattggcactgggatttgatgatctctattttattgccatcggagtaagcatcgtattaggaattttaatctttttttggcaacctttattatcaattaccgtcagtcctgaacttgctcaagttgaaggcattaatatcaaaagaatgcagtttctattaatgattttaaccgcacttaccattgcattaagtatgaaatttgtaggtgctttaattattacttcattactgattattccagcggcaacggcaaaacgttttgcaagaagtccggaaatgatggtgattattgctatttttgtgagtatgatttccatcacattaggattaacattatcagcattctatgatacgccttccggtccttccgttgttattagctctacgttcttatttattctttctttatttaaaaaagaaaataattaggtaaattacaataaaaagacgcaaggtaaccaaaataccttacgtctttctttttattattgaaaaattaatttatttccagagagtaggatcaacgcctttacgaagtaattgagggtattgttcaattttaaattcaggatctttacccgctttgagctgttggcggtaatcttttagcaacaacataactatcggtgccaataaaacaatagacacaaggttaattaatgccataatcgccatcaccgtatctgcaaagttccatacaatatttcctgaattgactgcaccaaaatacacaaagaacaacacaattaaacggaaagtgagaataaacaatggtttattgcgaataaaacgaatgttactttctgcataagcgtagtttccgataatagaagaaaatgcaaataacaataggataaaagctaagaaatgtaagccaaattcaccgacatggtactgtaaagcatattgggttaatgaaatgtttttcagttgttcgccaccataattatctgacaataaaataatcaccgcagtacaagtacacacaataatggtatcaacaaacacaccaagcatttgaatcaacccttgacttaccggatgtttgacatctgccgaggctgctgcattcggtgccgaacccataccagcctcattggagaaaagtccccgtttaattcccattagcattgctttggaaaaaattgcaccgaacataccgccagccatcgcatcaaaattaaaggcactctgaataatacgacttattactgtcggtaccatttcaatattcatacctaaaataatcaccgcaatgattagataaaacaacgccatcataggaacaatctgagcagaaactttaccaatacgtttcactccaccaaaaataattaaccccgttacgataacgagagttaacccgacatagtgcggttgccatttccaagcattttttgttgcctcaacaatagcattggattgaactgcattaaacgcaaatccgaacgtaaatattaaagcaattgcaaaacatactgccaaccaaggagctttcaatcctcttgtaatataataggcaggtccgccacgaaataacccgtttttatctttaactttaaataactgagccaaagaagattcagcaaatgcactggacattccaatcaacgccgttacccacatccaaaagacagcaccttccccgccaagtgctattgccgttgcaacgcctccgatattacccacacctacacggctggctaaaccagtagtaaatgcctgaaatggcgttaaagattgtccttgaacagcccgtccaaaccacatttcacgcaaactttgtggaaataaacgtaattgaataaagccggttgctaacgtaaaaaacacacctacaccaagtaatgtaatagtcgctaaatcccatagtggtccatcaaatttatcaacaaaccaacttagtgcttgttcaatgtttattattatagttgaaaacataatctacctcccattaaattgaaacgtgagtatttaaatacaaatttaaaaaaaacaaaaacaaaaataattaaaatataaaataaatattcttcaattagaaaaaatctaatattaaagcgtttaattaaataaaaaacaataaaaggaggttctacttttgaaaaaatactaatctcgtgataaaaagagtgcggccgcacctcgtacaccgccggaatcaccaaattttgcttttttaattaacggtactttcgctgtacgcattaaatgctgcggtaatgctttaggtaatgcttcatataaataatcaaagttggacaagcctcctcctaagataatcacatgcggatcaagtgcggtaataatattgccaattgaaatcgcacacagctcaataaaaagttcaacaaatttaaccgcactttcgtctttgtcataaaagcaccgaataatttctttagcggataacgcctttccttgtagatcacgatacaacatttcaaaaccacgaccggataagtaagtatccaagcatgctttattgccacaaccgcattcataaataggtgctttatcccaacctaacaatttcaaggcgtgataattaagttgcaaatgccccaattcgcccgccataccgctttgcccggaatgaactttgccgttaaatactaaaccgccgccaaaaccggtacctagaatcaaacctaatacgacaggatattgctggttatctttatcccaagcctctgacaaggcaaagcaatttgcatcattttccgcccgcacttctctacctaaacgctcagatagatcttttaaaataggtttattgtcagcaacacgaatatttgtaatctctgcaataccggtttcctgattaacaaatccgggaacgccgatgccaactgtacctttacaggcaaatttttcatcggctttttgcactaaatgggtaatgacatttaaccattcatcataactgtctttgggtgtatccactctttcggaataacgtttctccagtttttcattaaatacagcaagctcaatttttgtgccaccaatatcaaatccgtaatacataaatcctccaaatataaccaataccaaccgcacttttatatcttgtcaaaaacaaaaatatcttttctttgtaaataagcaaatataatcaaatgcacaaaccaagcgattaaaatagaagccaatagatcaataggataatgcatacctaagcgtaatcgactcactaacattaacaccgcccacacagttacaacaggtactagcaatttaattttagggttgcgatgaccaagtaattgtgcaaatccaacaactaatagcagccaagttgccgcaaacattgtatgtccggaagggaaagaataacctgtttcattagcatgatgttcgatcaaccaatcaggtgtggtctgttttgtctttgtttcttgataatattgatacactatttttttccgctcatggcgtttttgtgcataaaaatcatctgtactcatgtctgaattctgcactatttcttgcactaaaggacgaggttcagaaaacattgtttttaaaccgctcttaatgccttgagtcaaaataactgaacatgccataatcacaattgcccatattgcctgttttttatcccgaattgcaacgaaataaaataaagcaaatgcaatacaagtgataattgcataaggtgtgctacccgtttctgttaaaaaatataaaaaataatcaagcgaggcaacttcattagattgccagtgccaatcaatgaagtaagtaaaaattggtacaacgcaaagtaataaagtatataatgaaaaacgttttaacatcttgataactcataaaatgaacttatataaggctcttgcattttaacattatcaagttataaaaagctaaaaataagtataggtattttattatgtccaaaattcagttagttgctgaagctaaattacccaccgagttcggaattttccgtattgtcggctttgagtttcctgatactcaaaaagaacatgttgctcttgtaatgggcgatattaatgatgataaacctgttcttgcacgtatccattcagaatgtttaaccggcgacgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattggatacgattgaggcgaaccttgctttaggttttgctgctgatgaacgcaacttttcggtttgtgccgatatttttgcattactgggggtgaaacaagtacgtctgctcacaaataatccgaataaaattgaaaccatgaaaaaatccggtatcaatattgtggagcgagtgccattgaatgtaggtgaaaaccgctataacacagaatatctagatacgaaagcaaaaaaaatgggacactttattgtgcataataatgaacaacatttaatcgcttgtccgcattgccaagaagaaattccgaaaaaataattttcataggttggcattccccaacctatatttttaactaagttgtccaataatttatttttctatttaatctttctcacttaattccggtattatgtagcagttgcacaaagaccaaaattcaattttgaccgcaataaaatttctgatgcccttaactcccaaaacagagttaagggcatttcttttgcttaattctaactcattttcccacacattagacaaaatttccttaccgcagacgtaaccaatccgctcaaccttgtaaaaggtaagcaattttccctgatgcaaatcgggatgtgattttgcaattaaaagttaagctgcaagtaattcctgttcatacttcatcatctcattgagatttttgaagtaggtttgggagatttcttcaggactgaaagcggttataccaataagctcttgggttcgatgattaccttgccaatagccgacccattctcttaatggcaatacccataaacagcgtttaagaatatcattgaacagctcaccattagacttttgacggctatccgacataaaggcagcttgattggcgtaatgtagggcgtatttattatcacatttatggtgtacgccacgatgtaaatcacgaaagcgagcgttgaaggattcagcaagattattgttgatgccttgatagctatacgcttcttggtgattgactgaccaacgtgtgtagtgaaagtctaaacctgaataagcagggttttcatcacacatgatatggctgccacttttaacaaattgatgattcattttcaaaatggtttcggcactttcactgtaatccattgcaacaagggtgcggtttgaaccccacagattttcatcgttggaggctcgttggctaaagttgataatacagcgtttagtcgggcggaatttgggaagttttgtctttttgtctctctgtttatatctgtttttacggaaattaggttttctgagcctaaagtttatccacgccccatcttcgtgaatttcgccttgtaatggacttaaatcacgagttttgaatagggtttcacgcagtttatgacacaaaacaaaagcggttttgtaattgatatttaagtggcggctcattgtgatagcggaaataccttttacgctattgacaaatagggcgatggcagcaagtaaatcaacgagcggtaatttatgaaaagcaaataccgtatttgttgtgatgtagaaatgacgtttacaatgtttgcagcaccaacacttacgagattcgaggaaataagcgtgatgacgaacaccataatgtggacaacacacatcacggatattatcagggtttccccaacgatttgcttttaaaagttgaaaggcttcatcttcgcttaaacggaagatttttttgagatttaaattcttagatttgctagaaagcagatagtgctgtgccataagtattccttgtgtgtacaaggtactcaaagccaaatgccagatataaaaaatcgcccacctgaattttcaggtcggctcaaagcgttttgattgcttcgaatacctagcataagcaccataggaatggcgaaatttgataactcaccagtgaagttatctagtttagcggggctttagccctaaaccgtaatgaaacagcacatgtacgccttatataacaaacatacatgctataaagggtgttctagcaaattgtctatcttcaaaaatttgaagtattcttgattatagagtgaattatatagatattcaaccttaaatagataaagaaaagacaacgaataccgctgcctttgcttatatgattatgaataatattttgagggctgaagtcgattagacctaaatttcacaccattttcgcaaggttttaagctaccttttaagtattccaatgttaaactcgctcatggtgaaattcactcacatcaggggcatcatagatgcggtaagtatctttataactccagtagtccctcgctctcttttccctttgcgatgaccgccaaaatagctttcatctaactcaatgtttccctcaaaaatttcatcggtttcaagagataaatggtgatcctgacttcgagtatattcgaaactgaacgagcagtcacttctagcacaaaaactcaagtaatcttttttatatcatttccctttatttttttccttaaattcctgtttataaaaaatgcgagacagatcactaatttaacatctggttgttttctatacctatttcctgtgttataaacgtatttcctttatccaattattcctagaaaatccatagtaaaggtagcagaataatgtgtaatttttttagtaggttaaaacagcattttcgcaaacatccttgttgctgtgtttcattagcatttttacttctattattactttggttagcagatttacttcttgttcaaatcatcactcctttccgttgtgatatgtggaaaggcaaagagctagaagtttttttaacccccgaagaatggaggaaactatcgggcgttaatgaatcattaaaagatactgagtggatacattatccagctattgagggaaaagcagaaaaagatcctttttttataaagaataagggggtatatcagccagtaatgtattttaatggtgatagacattggctaagtgaggttaatagtaaatacccttacttaaatatatatatcccaaaaagatactagggcataatacatttatcttatacgatcaaaatttaaaaaaaagaatggtccagtataatatcataagaggctatttccgtgatcctttttttggggtatcggggagttttgattgtaataaaaatgctatgtcagatggctcagatctgatagaagattatttaaaataactagagaggtaagatatgtctaatgataatttggcgttgttggctgctgctgcgtatggcgaattctctgaaataaataatattaaggaaattcagaaaaccttaataaaaaaggctgaagtatccgctactcaagctgaaaaatttacagatacttatgaaataatcgctcatcaagcaaacacggctagtggctattcagggactattgttaaaaataaatattttacatagagagatattatgaaaaaaaagattcttgccgtatttttaagtattattacgattatatttatttctacctatccttattcattttggcttagtgaagtagttgttagaatggtgattgctgaatttgaacaaataatatttccaattaaaagaacaaaagttttgaatagcaatggttttaatataaaagaagaaatatgtatcccttataaaagtttttttggtgagtatgcaattaatattgatctaaaagataaatcgctaaaaccatttgagacaaaaagcgttttattaaatgattttgatttttatatatctatatatgatgataaaaaccaattattattttataacagccctcaagacatcagagataagtcgagagaaaaatataattctgtaacactaaatgaatatatttttcctaaatcagggtgttataaggttaatgttgaaagtgtagatgtaaataatagcaagtataaatatttatatttacgtatttttataacacatgccattccttaaattaagataaatgtaggtgattattatgaaaaaatatactttagaagttaaaatagcagaaagaggaacctcatataaaggtcatagttcttctgttgctgggcatattttctatgtattagtagatgaacatggcaacagaaaaagttttggctggggaaaaggagagaattcaacactaggtggaatagagaacattactaaaacagatgacatcgattattcagaaacaaatttcggtggctccgatgatgatatgttatacggtggcgacggggcagataccttgcttggtgaaggtggtgatgattatttagatggcggagaaggcgaagatgttgccgagttctcgggtaattttgctgactataaaatcactaaaatgggtgatggcttattaattagcgacaccaaacaaggacgagatggtacggactttttacgcaatattgagaagctgaattttaaagatattacgaactatcaagtaccagtaaccaataattttaagccacaacttccctccttccaagcctaaataactatttaatcccccctcattaaaacctaattaaacatcatttaactttttgtaaaataaactgcaagacagatcacaaatttagcatttagttgtttgctattttgaaaaattccttatactcgctaaagaggtttttataccaaaacttaggaaaatttgatgtcttttattcgtattgtattgtgggtacttttaggctggttcttactttgggctgggaaatggggttattttatatataaagcacatgagtcgtttttgcctgacgtaaatattcctcttaaattacaaaaaggctataaatacgtgtttgaatatatccctccagatgcaagtttaaaagagcaaacatggtcattagagatagagggaataagttttaataaagaatatgaaagtcatctaaaaaacttaatgttaaatgatggtattgaacatataagtaaaattaaagaggggtatctttatccagcaccagtaataaaaactagagtaaaaaatctagaaacagatgaagtgtatgagaatgtattatcttttcaaaacaagaactccagccatgtatgcaatgaaaccctacaaaatatttggtgttatcattatagagctgatgtactcacaggacaacgttggctaagatttttccctaataatagatatttaatagaaattgaagttctttattctgatattagacaagcaaatttaaaatcaaaacttgttctaggtgatgcacatttaaaaaaaacatatcgtttttaaggagatatcatgggtaattatattgtcgaaattaaattagcagaagtcggaactgaatatacttttcaggaagatcgaaatgatcatgataaaggagataaaatctcgtcaatagggggacatgcttggctttctattcaaggttctgacggtaaagttgaaggttttggatttgcttcggagaatgctaaagcatttgatgtaggaagaaaagttgatgatgacaaccaagcctatgttcacgcaaatactattatcaaatttgaaattaccgaagaacagtataaaagatttacgcattttaaaaaaacaggagagtattcaggagggagatttgattttagtagatataatcttgactctcataactgtgttacagctgttgcttcagcgttaattgcaatgggagtaaataaagaaaaaaatcttattagtccaaatgagattgatctaactcatcatttaacatcttcatcttttttcgatgatacaaataattcgggtcaacacacacggaatttacaggtgttggaatatcagggctaaaattaataaaaaataatatttatacaactgaaaaatatagacatggtaaacttgtaaatacatccgtaataggaacagcaccaactactccaattaacaaaaccccaaccaacaatttcgacatttccactaccccaatcctagataaaaactctaataatgatgcggtttctctttctcctgcactctatgccctactggacaaagatatattaaataaacataacgatccgttttcagtttccatgtcgaatattaccactaatggttttagagtatcgaactataatctctccaaaggtatttttgacaatgataataaatccgtccttaatgaaaaatattcttttattaaagatccaaaactgcttaataaagtaaaaggttttggttattctcgcttacctgtcgatccccttatccttgatttaaacggcgatggtgcaagagcggtgagttataccgaaaaaccggtattatttgatattgataatgacggtggctctttagaagaaacaggttggttaagccatcaagatggattattggtgagggacttaaacaacaacggcaaaatcgacaatatgtcggaagtcttttctgaatattatgcgggcagagcaggacgtaatagcgaagcaggtgaaaagcgttttgctaatggttttgaggcgttaaaaagtttagatagtaataaagataatgtatttgatagcaaagacagggattttaatgccgtgcatgtgtggcaagatgccaatcacaatggcgtaacagataagggagaattaaaaacccttaaacaattaggcattaccgctatcaaattagattatgaagagaaaggcggacaactttttaatggcaatgaattattagcaaaaggcagttttactcgcaatggtaaacaacaagaagtggtggcggtaaactttttagccaacccgagaggacatcgtattagcaatgccaatggcggtaagaaaaccgtgacggaagcctcgggtttaattcagggcacgacaggttggacagccgttgatgatgtcaatcgggatttaagtgcggtgacattaggcgttgaaaacatccaagcaggcaatggtcatgataccctacgaggcgatgagcaagataactggcttgctggtggtggagatacgatacggcacaattccaatatcgtactcgccgccgccgttttaccacaaattcagctaccttaattatccgtttactcaaaacagagccacatcgttattggcgtgttgaagaaattacaaaagcaatcctcatagcagataaccaacccaatacccctgtaaatcgcacctatattaagaatgttcatgcggcaatggataggttgctcaaaaaaggcattgtagaacgacagtcagacaagactcacaagatggctttatggcgattaaaaaccgagaaataatggttatcactgttatttctacgttgcaatctcttttaatcgccactgaattaccttaaccgaagatttctcttgcaaaacctgtctctcaacaatgcctttctcttgtaatcttcttaatgcgtgtgaaaaggcagttacaattgaatgatgctgagatttatgctctcttttcccttcaatctcaaatgctttaaacattatctctttcgctgacatccattggtttgggtaatgtttaaacacttttgcaatataatcgctagggtgataagcgtatattgaaatcacatttccattaccaatagatttagctttcctcttgataggacttgaaaacggatcactctgtaatgccactaaggcttgttgtagagttacttgatgctctttcgccttttcaatacatcgctcaaagtgagtaatttgttgagtaagttcagcaattttctgccgaataagggtttccccactcattcttgccataaataaaaatccttatgatgtaaaataaccacaaggattttagtcaaatttagttaattggtctttgtgcaactgctacataataccgcttaattctgtgttaaaatccattttgcatttttaacccgatacaacggttacgaacaaatataggtaagataatgctccctagattaaaagatattcctcaacttgatcctttagtttctgcctatttggaaaaattaaaaacgcaacattttgaaggtgatatagcgacaaattatgcagaacgtttaagtttagcaaccgataacagtgtttatcaacaacttccacaagctattttatttcctaaaacaacaaacgatgtggtatgccttacaaagctggctcaacaaaaaaatttccaatctcttacctttacgccaagaggcggcggtacaggaaccaatggtcaagcaattaaccataatatcatcgttgatctttctcgttatatgacaaagatcttggaactcaatgtggagcaacggtgggttcgtgtacaagccggtgttgttaaagatcagctcaatcaatttttaaaaccctacgggttgtttttttcaccggaactttctaccagtaatcgagctactattggcggaatgattaatactgatgcttccggacaaggctctctaaaatatggtaaaacttcagatcatgtactagcactaaaatctgtcttaatgaatggagaaattttagaaacaagtgcggtcaaatctgatgaatttttacaaaatattcagcatttatcatcaacaggacaaaaacttcatcaagaaatctttcaacgctgtcaacaaaaacgctcacaaattctcactgatttgcctcaattaaaccgttttttaaccggctatgatttaaaaaatgtatttaacgaagatcaaagcgaatttaatcttagtcgtattttaaccggatctgaaggttcattagcttttatttgcgaagcggttttagacttaacacctattcctcaataccgcactttaatcaacatcaaatatagctctttcgatgcagcattacgcaatgcacctttcatgctggcggttgaagcattatccgttgaaaccattgatagcaaagtactaaatctagccaaacaagatattatttggcattctgtacatgaattacttacggaagaaaaagaaaacccaattttaggtttaaatattgttgaatatgcaggaaacgaccgcaccttaattcaaaaacaagtatctcacttatgccaactgttagacgataaaatagctcaacaacaagataacattatcggttatcaagtttgctcagatcttccttccatcgaacgaatttatgctatgcgaaaaaaagcggtgggcttattaggtaatagcaaaggcaataaaaaacctattccttttgtggaagacagttgcgtaccgcctaaaaatctagccaactatattagtgagtttcgtcaattattagataaacatcacctagattacggtatgtttggacatgtcgatgcaggtgttctacatgtacgccccgctttagatttatgtaataaagaacaagttttgctattcaaaactatttctgatcaagtagcagatttaacaaaaaaatatggtggcttaatttggggagaacatggaaaaggaatgcgttcacaatacggtgaaaaattctttactccggaattatggcaagaattacgctacattaaatttttattcgatccgaataatcgtttaaatccgggtaaaatttgtaccgcactttattctgaacaagaactctactccattttgtcgccaatgcgggcagatcaagatcgtcaaatccccattcaaatgcgagaggaattttccggtgcgatgaattgtaatggtaacggattatgctttaactttgatgttcacagtgccatgtgtccgtctatgaaagtcagcaaaaaccggctattttcgcccaaagggcgtgcagcaataattcgtgaatggttgcgtttgatggcaaatgaaaatatctcgcctgaacagctgaattttcgtaaagtcgaagtgaaattaacagatcttgtcaaaaaaattcgcaatacggttgcccaaaaacgaggggaatacgatttttctcacgaagttaaagaggctatgaatacttgtttagcctgtaaggcttgtgctacgcaatgtccaattaaaattgatgtgcccagctttcgtgccaagtttttctatttttaccataaccgctatttacgcccattgaaagattatgtggttgcaaatgtagaaatgatggcacctttaatggcaaaagcaccgaaatttttcaacttttttacaacggctaaactcactcaatctttggctgaaaatctgctagggatgactgatttaccctcattgtctgttccctctttgcaacaacagttagttgaaataaattatcaaggttattcattggagcaactggaaaatctaagtgcggtagaaaaacaaaatattttattgattgttcaagatccgtttacctctttttatgatgcaaaagtcgtcgctgattttgtagcactctgtcaaaaattaggttacaaagcaattgttctgccttttaaacctaatggtaaagcaatgcacataaagggattcctagcacgttttgccaaaactgcaaaaaatcaagcggacttcctcaataagataagtaaactcggtttatctctggtcggtgttgatcctgccattgttctttcttatcgtgatgaatataaagaaattctcggtgatgaaagaggagattttaatgttatcactgctcatgagtggttgaaacaagaattaagttcagggaaacttgagcataaacttacacaaattatgcaaaaaaataaccgcacttttaataaagaaagtcaacaaaaatggtatttatttccacattgtacggaaagtactacactaccgaacaatgcaaaagaatggcagcaaattttttcagcttttggacaagaattacaaaccaaaaatgttggttgttgcggtatggcaggaacgtttgggcatgaaattcaacacctagagatgtcaaaagaaatttaccatttatcctgggctaaaaaattacaaggaaaaaatcctgattattgtttagctacggggtattcttgtcgcagtcaagttaaacgtatgctccattggcaacctaagcatcctattcaagccctattatcaattatttaaatagaaagaacttgttatgaaaatttggaaaaaaaactacacattagatcagcttaaccaattaaccgccaattgtgccgttgcacatttaggtatagaattcactgctcaaggtgatgattggcttgaagcaactctccccatagatcatagaacaactcaacctatgggatatttacacggcggtatatcctgtgcattagctgaaacagtagggtcagcggcaggtttttgttgtgttgatgaaaatcaagcggtacttggtgcagaaatcaatgcaagccatttacgccctgctacaaaaggaaaagtgacagcgagagcaacaccaattcggataggaaaaaatattcacgtttggcaaatcaatctttacgatgaagaacggaaaatttgttgtagctcaagactaacattaagtgtgatagcaattaattaacaattaaataacgttgctcgttggctattaacaccaatccacaacgcatgatttaccattgacatcacaagataataatttaggaagttatacaatgaaaaaagacaataaaatactcggcgtagtgctaggcatagggcttattttagtggggatatttatattaaacagtcccttattgactttattgacaattatttcgtaccttgcatgggcagttttgctcagggggttattttccctctttaaatgttataaatcacataaaaatacccaaccatttgataaaacagaattagccgccggcatcgtcttaatgattcttggcgtgatattcttaaccaacccttcatttaccaatgcacttgtattttatttagtcgccttttggtttatatttgaggggattgtcggtatatattatgccgccaaacaaaaagatgtagcaaaatgggtaggcattgtgctggggatttttctcgtattttttggcttatccatttcagtagaacctctcagagctatattggcactcaatctattgctgggattggcagtagtaaccaacgggattcaactcctaatcgttcaactgatgaaagagaaatagagggctaccgaatgaaaaaaatcggtattattcttgccaatttaggtacacccgatgaacccactcctaaagcattatctcgctatttatggcaatttttgactgatccacgtgtagtggatctacctaaatggcgttggtatccgttacttaaaagcattattttgcctcgccgatcagctcgggtcgccaaaatatatcaaaccgtttggacagataaaggttctcctttacttgtcatttccaatcaacaaaagcaagcgttacaatcccacttcgatgaacaccggattaatgcaacagtagaaattgcaatgacgtatggtaacccgtcaatggaaagtgcggttgaaaaactattgaaaaagcacgtgaatgaaatcatcttgttaccccttttcccacaatatagcagtacaactaccggtgctgtctttgatgcttttgcacaggcattaaaaaaacaacgcaacattgtgccttttcagtttattcattcataccatttacatgaagattatatcgaggcactggtaaatagtattaacactaaacacaaaccggatgaatacttaattttttcttttcatggcataccgttacgctatgaaaatgaaggagattattatcgtaaacattgtcatgaaacagttttagctgtagtagaacgtttaggcttgcgtgaaaatcagtggcaaatgacgttccaatcaagattcggaaaagaagaatggttgcaaccttatacggataaagtgttggaaaatatttatcaacgaaatatacaaaaagttgccgtggtttgtcccggattttccgcagattgtttagaaacaatcgaagaaattaatgaagaaaatcgaagaatttttctctctcatgggggagcgtcttttcaatatattcccgcacttaatgcagaaatgcaacatattgaaatgatgtataaattaatctcaagtagattataaaatcaactggtaaaatagagctgtaaaatactctatttacatctaaaaacattaatcttaaaatgccccgtcatcgcataccactgtcagttaaatttgctgatttatctttctaactctcaacgaattaaaggaaattgagatgaaaaaattaactaaaatgactttagctaatctgattttactcggagcgattcaaacagcgaatgccagtgataatactgtgtatctttatacatggagtgaatatgtccctgaaggattattagaaaactttactaaggaaacaggcattaaagttattgcatccagtttagaatccaatgaaacaatgtatgccaagctaaaaacgttgggtaaaaatagtggatatgatgttattgcaccaaccagctattttgtttctaaaatggcaagagaaggtatgttaaaggaattggatcatagtaaacttccggtgataaaggaacttgatcctaatatgttggatagaccttttgacaaaggtaataaatactctctcccccaactattcggtgcaaccggtatcggatacaatacggacagtcaaaatccggaacaactgcaatcttggggtgatttatggaaccctgaatttgcaaataaactgcaaatgctggatgacccaagagaactatttaatattgcattactaaaaatgggggaaaatccaaatacccaagatccaaaggtaatagaaaaagcctatcaagaattattaaagctacgtcctaatattttagtttttaactctgataatcccgcaaatacctttattaccggtgaaacagatgtcggcttgatttggaacggatctattcgtgtcgcacaaaatgcaggcgtaccgattaaaattgtttatccaaaagaaggaaccatgttgtggattgataatttagccattccagcaacagctaaaaatgttgaatcggcatacaaactcatcaattacctgttaagtgcggatgtttccgaaaaattaacgctcgaaataggctatcctacttcaaatctcaacgctctcgaacgcttgccaaaagaattaaccgaaaataaaggtatcttcttaccgcaagaagtgcttgatcgaagtcaatggcaagtagatgtaggagaggcggctgaactttatgaaacttattatcaaaaattaaaaaatatgcaataaatacttccccgaaaagaactcatgaatgatccccgtaaactgcggggattttatttatcagataaactatttttaaatatttttactcatcaacttaaatgaagtttaattcgctttatattcttcaatcacaacaggtaaagtcaaggttttatctaaacgctgtatgaccatatttattgtggtattaggtttagtattactaatcgcttccatcatttgagcaggagaaacagcatcaataccatcaaaactaacaatcacatcaccaggctgaataccggctttatgtgcagggctaccttgtaatattgatgtaattaaaattcctttatctcttaacccctttccattgctaaatagaatatcactttgcacccctaagtaaccacgaataactcgaccatcacgaatgattttttgcataacatcattagctaattcaataggaatggcaaaatttaatccttccgcaatttcgttggcattcttaccaatacttaacgtacttataccaatcaattcaccagcagaattaatgagtgccccaccggaattaccacgattaagaggtgcatccgtttgaataaaattttgtcgtccaatgaaatcgccaacagcattacgacccaacgcactaataataccttgcgacacactttgacctaggttatagggattcccaatagataaaacgacatcaccgacatgagcttgccgttttggattttgtggaatggttgccagattatctgcatgaatttttaaaaccgctaaatctgtcaagcgatccgaccccactaacttcgcttcaaaaatacgtccattttgtaatgccaccacaatttgatccgcattttgaacaacatgctcattagtcaatatataaccatcttttgacataataacgccggatcccaagttattaatttgtggctggtaattattggttgtaaatgcaaaagcttgattataaacattaactaccgccggtgaagcaatacgtacagcatctttataagaaagaatatctttttgtataaaaaaaacatttgtcaaatacccatttcctttgaaaacaggcaatataagtaacaccaatgctgcggcagctaacccagtgattattgattgaattaatttttttatcattatgtgattgccctcagtatcataaaatgtgacgctgataattcaacttaatgtcttcgccaatttgtgccaaagataacaattgccactttggtgcatcggctaaacgcttcaaatgtggcaaatggcaaaaaccacgagctttattacccagtaatttcggtgccatataaataatgagctcattcactaaattttcctcaataaatgcaccagctaaagtttctcccgcttctaaccaaagactattaatctgacgctttgccaattcaatcaacaagttttccaaataagaatgctcgttacttgggaataattttatatattgacaataatcaggaaacgctgacatatcacgctctttatcacccaccagccaaacgggagattgacattgaaataatttatgacgaggtgtcacaagatgctgacgatcaagaataattctgacaggttgacgcacatcttcaactttataattttgttgtaattccgatggaaattgctcccaacgaagatttaacaagggatcatcggctaacaccgtcttagctgtcgataaaattgcagaaactttagcccgctcttgctgtacgtcttgccgtgcctgttctccgctaatccatttactctcgccattagccatagcagttcgaccgtcaaggcttattgccattttcaagataacaaaaggtttctgtgttctcattcgtgttaaaaaacctttgtttaataattccgctttttcttgtaataatcctaccgcactttcaatacctgctgcttgcaacatagctaaccctttgcctgcaacttgcggattaggatctttcattgccacaataacgttgcgaatacctgcttcaattagtccttgtgcacaaggaggcgttcttccgaaatgagaacaaggctctaaagtcacataagcagttgccccctttgctctatcaccggcatcacgtaatgccataacttccgcatggggttgccccgctttaaaatgaaaacctctcccaacaatttcaccatttttgactaaaacacagcccacagcaggattaggtgttgtggtaaatatgccttttttcgcaagatctaaagctatctgcataaaatattcatcttgagctgaaaatgttggttgcatcattaatcctttaatttttcaatttcattggtaaattgattaatatcatcaaaactcaaataaaccgaggcaaaacgaatataagcaactttatccaattctttcaattcagccatcactaaacgcccaacatcttgacttttcacatcacgctcaccagttgctcgtaattgataaataatgcgactaattgctttctctacatcatcagaactcacaggtcgtttttctaaagcatgttgaatacctcgacgcaatttatcttcatcaaaaggttcacgtgagccatcatttttgataattttaggcacaataacttccgcactttcaaaggtcgtgaaccgctcatgacaatatccacattctctacggcgacgaacctgataaccatcagaaaccaagcgactatcaatcacctttgtctcctccattgcacaaaaaggacatcgcataaaaaatccttaattaatcaaaaaaaaataaagcttatcttagcaaaatagacgtaacttgacgatatatttacatgtcagtcaacaacgaaatgagagttcccttttagatttagaataaattttgacattcattttcttttaagcgtttaatgaaaaacatgttgtaccaaaaccatatacaaaacggtaccgactgcaatggataaaaacatgtttttttgccaaaaatgcagtactaataccacaataccagcaatgaaatcaggtataccacgatgacctgtcgtcagatcaatatttttatagcaatatactaccaacataccgaacattgctgccggtaatactttgcctaaatagcgaatatattccggtacagggcgattagctggaaaaatccaaaaaggcaaccagcgaaaaagctgtacacctaaaattcccataccaatagtgattaactgttcatgaaaagtcacttatctctccctatctattcaatttagtcgccagtttttgcgataatattgaacggcgtaatgttaaatacaaccaaatgccaatcagtgttggaataagaaaaccctctttccctaccgttaataaagaaatcaatgcgattccgaagccaaataatgaactttcatgagatttttcttttaaccaattttcagcaaaaataactaaaaataaggctgtcattgcaaattcaacaccggcgagatcaaaaggcaaaatagaaccgaatagcgtacctaaagcagcaccaatgatccaatagcaatgtaaatataaactgacaaaaaagaaaaaccagcctctatctatattatgaggaatttttgccatatagtttaaagaaaaagcttcgtcaactaatgtggcaatcaaataccaccgttttttacccaaatctccgctgtatttctccagcattgagatggcgtaaaaaatctgccgcccactgaccattaatgtgattaataaaacgtgccaaggagaaaaagtactaactaatgctcctgcaacaataaattctaccgaaccggcataaattaaggttgccattaaaataggataccaagttgcaaatccttgcactttcatatataccccataggctatgcctaaaaacatgaatccggcaagaataggaaaagaatgaggcaaggctacttttgccgcattccatacggtttttgattgattaagatctgacatacaataactattctaaaatagacaatccatgcaaggtagaaaaacgttgagatttaataatctcatagaaatcatcaataaaggcaatatcattatccgtttctcggaaagcaccatagagatcactatataacccttcatcagtaatttttcttgccacaacatagcctctatccaaataaggttttactgcccaaaacggcaatgtcgccacaccacgtttacttgctacaagttgaataatagcaatggttaattcacttgtacgtcgagaaggattgatgcctttaggatgtaaaaccttacgtagaagatcgagcatatcatcaggcacagggtaagttatcaaggtttgctcaacaaaatcttctgcttgccaaacctctttcctcgccaaaggatgatcctttgcacacaaaccaaccatttcataggaaaacaagggcttatgaataatacccggcgtttcttcaatttctgatactaccgcccaatcggctcgatgactcagcaataaaccaatagcatctgtatggaatccagacacaatatcaagttcaactaaaggccaatgttgacgaaaattatccatggcaggcatcagccaatcaaaacaagtatgacattctacagctatttttaactcgcccgcctctccttgtttaattctcgataaagctcgttcagtctccatgaccttaggcaaaatttcattggctaatttgatcaaccgctctcctgccgctgtaaaccgcaaaggatgacttttccgctcaaataaaggtaattgatattgttcttccaataatttaatttgatgcgaaagtgccgattgagttaaataaactctctttgctgccaaagaaacactcccagtttcttttaacgcaatgagcgtttttaaatgacgcaattcaagaaaaataggtttcatgaagattttgataacaaaaaacaatttgccgtattgtacagcaaaataaaaggatcaaaaaggctttctcctctttgacccttagtcaactacatcaaggtaaaaccgatctttaccctctccacactaagtgcggttagttattgacaaatttttcgcctaattcaatatcagctcgtaaagttggcaacatatcttctaaggctttttgttcaaatgcacttaaggtacccaccggtaaaatttcctctaccccttcttttcctaagcgaacaggttgtgcaaagaaacgagcatatttaccatcaccttcaacatacgtacattccacaacagtttcaccacttagcccctgtaccagtgagagagcaaaacgtgctgctgcttgagccattgaaagtgtagcagaaccgccacccgctttcgcttcaacaacctcagtaccggcattttgaatacgttttgttaatggtgctatttcgtcctctttccattcggtatattgcacttgggataacaatggaagaatcgtcacaccggaatgtccgccaattaccggtaccgcaatgcgtgaaacattgagtcctttcaattcagcaacaaaagtttcagaacgtaatacatctaatgttgttaccccaaataatttacgtttatcataaacgcccgcttttttcagtacttcagcagcaattgctactgttgtattaaccggattggtaataatacccacacaggctttaggacaagttttagcgactttttcaattaaatttttcacaatacctgcattaatattaaataaatctgaacgatccattcccggtttacgagcaacaccggcagaaattagtacaacatcagcgttttctaaagcgggaattggatcttcccctgcaaaaccttgtatcttcaccgctgttggaatatggcttacatcagcagcaacacccggtgtaacaggtgcaatatcatataatgataattctgaacccgcaggtaattgtagttttaataacagagccaatgcttgaccaatacccccagccgcacctaaaacagctattttcataagaacctccttatactcatacagttacaaattgaaccgcacaaattttaaaatgatcaagttcttatttcaaacaaagaaattaaattgtgcgatctacctcaaatttttaacaaaaattatttttaaatgttgaaaactaagaatataaatataaaaattatctacctattttgcatttttatgcagcattccccaacgtcgatttaagagagaatacataatgatcaatgaaaaagcagatagcctagtcaacgcttttaaagagctactttcccaagaaagctttggttcccaaagcgaaattgttagtgctttacaacaaatgggatttactcatgtcaaccaatcaaaagtctccagaatgttaacaaaatttggagcagtgagaacacgaaatactcgtatggaaatggtatattgtcttcctaatgaattgagtgtacctaataccggtagcccattgaaaaatctcgtgttagatgtagatcataacgaaacattaattgttatcaaaaccagtcctggtgcggcacaactcatcgcaagattactggattcggttggcaaatctgagggaattttaggcacaattgcaggagatgatactattttcgttacccccaccacaggaaatgatattcagattttaattactaatatccaaaaattattcgaaagttctttataggattgtgatgaggaacataagatgaaaatattcatcacaggtgccaccggattgattggctcaaacttaatccctctcttactggaaaaagaatatcaaattaccgctctagttaggaatatggagaaagctcgtcatcagctacccaatcaagttcagttggtcaaagcactgtctcattatgagaatttcaatgattttgatggcgttatcaatcttgccggagccccgatttttgcccaatattggacagccggctataaaaccgaactcattaatagtcgccttaatttaacggaaaatttaaccgcacttattaataacagtaacaaacctccacattgtttcatttccgcttccgcaacaggttattatggcgatcaaggaaataatctcattactgaagaatctctgagcggaaatcaatttaccgctcaattgtgtcaacaatgggaaaatattgctttacaagccaacagcagagtgtgtttattacgcactggaatggtgttttccgaaaaaggcggtgcattaacaaaaattctaccaatttatcgttatggacttggaggaaaactcggtaccggcaaacaattctgggcttggattagcttacaagatatgttacaagctattctgttcttgttggaaaatgcacaatgcgaaggtgcgtttaatctcgttgcaccaaaacctattcaaaataaagatttcaattgccaattaggtgcatggctaaaacgtccttatttcacaatagttcctaaatttttacttaatttattgttaggtgaacgagcgacccttttattagacagtcaaaatgttattccacaaaaattattggaagccggatttcattttagcacaccgacattcagcgattttttacattcgataaagaaataggacatgttatttacaaaaaaaccaccgcacttaattagtgcggtggttttttcttagggtgtagcaagttggctaaattaccactgataccccacaccaaccgaaccgccgacatcgcccgttgaactgcgagtaccttgcaatcgtagcgttattttaccattatcacttactcgtgaataacctaacgccaccgcactttgtcctttataggaacctgccgaagcagcaaacatggatttacccggcacagaagacatcggcaaacctgaagttgccaaagcacccgcaatccccgctcgcaattctttattggacatatccagtttattgttgagattgctgagtttttggtcggtttgtctttgtaaagtatccacatattttttattcaccaccgcacttccactggttgttggtttaatatccggcacggtaataatacctttttcaccatcaatcttaatttcaccgtttgctccggttacggttaagccgtttttattaagaacagcttttggcatttttggattttgctgattttgtgtcgttgcgttgtcagcaaaggtcaggctttcagcagttattgttgctttattgccagttttcttatcttccaacatgatattgtccgcaccataggtggcagagatgtctttgccattaccatttttgttgttgacaacttttaagccctcgctatttaacgtggcttttttaccgccctcctctttggtttcaaaggctttcatatttttcaaggtatccgacagttttatttctaaaccatctttggctgtattggtttctaccttaatgttaccagcggcactactaaatgaacttgtagcttgaccgttttgagtttcctcttcccctttaatggttaaggtatcgctgatttttctgactacatcatcgccctgatttcctttaaatctcaacccagcttgtgcaaccgcttttaagtcagcgagattggcggcttgatgcagatcttgttgctcagtcattttttgcccttgctggctacttatgccgttggaaaccagttttttcactagatcaagggatttaccttgtttttcagattcagacttacctttcatactatcattatcaattcccaaggcggattttagatttttgatggcaacagggtcatgagccttacctccattttgaggtttaccgcctaaagtgattgattttttatgttcatcatcatatttcaccgctattttatccgcttctgtctgttggtcggtgatggtcttgattttgctgtttacaaagtctttcaccgccttagctgtagtaagttttttgtcctcagcactagaatttccgctagaaccgtccgcacttccattttccttaatttcttcagttgcctctattttgaaggaaattgttccggtgtcggcatcaatactcggtttgatatagtcatcgcctttaaatttaatcgtagccccaagctgacgggtcattttgttggttgatgtaccgccggtttgaggtgcggtcgtagttgctgttgttgtagtaccatcgtccacctcaaaaattaaacctttgttaatggttttaatgctttcatcaatggcttctttaaatgtcgtggtagccttatttttagtgccatcttctttgtttaatgcggtaaacgtagttttcttaaaaccatcaccgctatcatctttctccgcccctaatacgtccgtaccgagtttaccgaatacctgaataacattgtaaagctgtccaccattgacggcatcagttgaggtatctttgacttcaccggcggcgacataagtaataatgcgttcagcatctttcttacccacgctgatgacttctttattagccccaacacctgctgaccagctgatttttatatcatttccacctacattttgtattgttccactaggtgcggtctttttattcacgatttgagaaccatcgcctaacgcaaaggaattatcgccgtctttaccattaactgtaattacatctagctttttctttacttggtcagcaagtttgatagtaactttttgttgcttatcttcaactttcgtttcaatctcatctgttgttcccaaaacctgcaaggcttgactttgaattttaacagcaccttggacttttccgtttgaggattgagattgtccgctagaagacggcgtacttggagccgcactttgagcttgtccaccggcttgtgcttgtgcggtattggaattatcagcttcaatttttagcgttaatgaattcaattgatttttcaagtattctttaaccgcacttgcggtaaccagtttattgtcgttttggtcagttgtactgcctgaatttgtatcactaatagaagtagccactttgagcttaaaggtaattttaccaccgctgttatcaaggctaggcgtaaggtaactatccccaccaaacgttagcgttgagccaagttgacgggttaaaggaccgtttccactcgccattgatgattgagctccaccaccagtttccactgcaaattttagcccctcgttgattttggagatattggcattaattgcatctttaaatgtgtctttagtcgcttgatttccaccacttgtatctttcaatgcagtaaatgtagttttcttaaagccatctcctctatcatttttctctgcacccaatacttccgtacccagttttccgaatacttgaataacgttgtaaagctgtccgccgttaattgcatcagttgaaccgtcccttacttcacctgcggcgacatgggtgataatgcgttctgagcctgtagaaccaacgctgacgacttcttttttattgccttccattgtatcagcagaagcaccggcgtttttccagctgattgttacttcactttgtcctgtgttttgtgtagttccactaggtgcggtctttttcttaacaatttcagaacctttacccaacgcaaaggaattatcgccgttgccattaacagtaatcacttccaattttttcttcacttggtcggcaagtttgatggttacggttggtttgtcttgtgtaacttctgttttgatgaaatcactttcacctgttatttttagtttgtgtttatttaactcaactttaccaacagggttggcaggggtgcttccgttttgggtgttatccccctctagttgcaacgtaccaccaacattttggagtttttgggttatgtaggttttcaccgcagtttcagttacaagtttgttgcttgaactacctgaacttcccccactattttgttgagtatcattaattgtgtcggttgactccgcttcaaaggaaatttcgccttttgagctatcaatcgttgctttgaggtgttttccgcctttaaaggtaaccgtcgctccgagttgacgggtcatttcagttgaatttccagcagaaccgcccgcacttgtgccgttttcgactttgaattttaagccctcgttgattttctcaatgtttttggtaatagcgtctttaaatgttgttgaagctggatttgtctcagctccgtttttatctttcaacttagtaaacgtagtttgtttaaaaccggctttgttagtttcggctttttctgcacctaatacgtcggttcctaaatagccgaatacatcgataacgccttttaattgcccaccgttgatcgcatctgtggaaccgtccctaatttcacccgcagcaacatgtctaataactctttcacgtcccatatcccctatacttagcacggattttttatcagaatcggatgcagatgttccagcattttcccatttaaataataggctataactgccattaacacttaactcttgtgttttaaatgcttgtttcttatcttctgccttagaacctttacctaaagcaatcgaatcccctgcattagtggatacagacgcaccctccccaatcgctaccgcacctatggcacttgcttgaacagttgcatctttaccaatcaccaccgcactttcagcttgagaaattgcatgtttaccgataatcactgaatttttggcgtttgttattgtgccattacttccgccgttctcaccatttcctattatgattaaatttgcattgttagttcctacactaatattacttcccaatgcaagaatgttattatcggaacctgttatggctattttgtttcctaatgcggttgaccatttagaattgattatttttgtttctcctgatacacctatcgctattgaagcatcgctattttccaatacttttgcttgataccccaacgctaaagattgaattgatttaacctgagtttctgcacctacagcagttgaccatttggcatttgttacatttgattgataaccgatagcaacggaatcgtgtgaattaccattttctacttttgcactatgaccaatcgcaatagaattttgggcttttgctccgtcgttatcaaaattgtcgtttctgttacttgttgtgccggaagcggcggtgtcatttcttaccgaaatataatgcaatttcgccgcttcaagttgtttaaagtttacggcatcgttttgatctgagccatcagcaacgcctgaaattttgactttactatttccattagttccggtttgtgtaaatgttaaatcagtcccaccgacttttaacgtggcagttgatgtactatttgacccattactaaatgatagaatgttattattatcttttcctacgctgttaataccttttaaggtatcgctaagtgctattgttaaattacttccagaagacgtagtggtaatatttttatggttgccatttgaactatcttcttttcctttaatatttaaagtgtctcctaattttagagattgttctccgccagtatctccagcaaatttaagtcctttgtttatcgctgtgatggtatcttcaattgcttctctaaaagtagacttcctagcattagtttcatttccattatatgaaacagctttaaaagtagtctttttaaaaccatctgttccagtatccgctttttcggcaccgagtacatttatccctaaattagcaaatacatcaattacgctataaagttgcccgccattgatagcatcggttgaacctgattgcactgttccggcggcaacattcgttattattcgttccttaccgctgtccccaatacttaaaacggacttattagctcctgctccggcactactccaagaaattgttatatcattagctccagtagtagatgtaagaccggttggtgctagctttctagtggtcgccttagaatttctccccaacgcaatagaatcgccagcggcggtggatacagacgcaccctccccaatcgctaccgcacctgttgcacttgcttgaacattcgcacctttaccgagtaccaccgcactttgtgcttgagattttgcatcttgaccaatcaccacagaatatttagcattttcagcgtttgccttattaccaataatcactaaaccactgtttgcactcttttcatcgccaccattcgctttatttacgttaatattattccccaacgccacgatatctgtaccgctgttgattttggttttattaccgatggctaatgaccattcggcattatctaattttgtatggtcagaaccatctccttcattaaccgcactgatagcgattgagccttttgcattgttgaatgtaacgccgttaccaacagcgacaacagcatcttgtttttctttactgccttgtgtaaccgtaatacctgagcctaacaacacggaatgttttacatcaacattcaagtccttaccaattacaatcgcttgttcagcttttgatttcgcttcgtacccaagggcgatggcatatttttcggtcgcttccgcccccacaccgatagcgatagcaccctccatctttgctccatcgttattgtagttgccttttgtgccactcgaaccgctagaaccgctacctgcaccgtttgtaccatcattcaccgacaaataatgcaaagattgcgtaccagtactgcttccgccacttccgccaccgcttgtaattttactatttacatagtctctaactgcttttacagtcgttaattttttgtcattgccgttgctgttaccgcctgatgtgctgttaattgaatcagtcgcattgacggcaagcttaattgtgtccttaccactactaccttcagtgcttaaagtcagataatcgtcgcctttaaaggtcaatgattgtccgagttgtcttttgatagtattgttgttactgctaccacttccatttcccccaactttaaaggtcattccttggtttatggcttcaatagtatcttgaatagcttctctaaacgtggtttgactttttcttgtatatccattactttgaactggcctaaacgttgattttccgaaacgttttccaccatcactttctccatcaagccaaacttgtgcacctaacacctctgagcctaatttcccaaaggcttcaatcacgctatataattgtccgccatttaccgcatcggttgagccattttgcaccttacctgcagcgacatgttttagtagggtttcggtgctaccgcttcctacattaataacgtttttattttcaccagcacctgcgtctttccatctaattcgtatagaatccgaaccaacattcacctctgcactactaggggctaattcttgaccccctctcgaaaataaatcacttaactccgtggctttggtgattttttgggttatatcgtctttgagtttgattttgatggggttacttgaacaattgtgtattccttgattgtttgaagccccaaatccccctcctgctccattgccttgtttactacaagtaaatgatcctacatctacatcgataaaaccttctccctttatccccgttttcatcatgttttggacatctttcgcttcaccatcttgtaatcctgtaacaccgggggaaaaaccttgtcccaaaacctccaccggcaacaccaccgacaacgctaacgccagcggtgcgagtttaaacgccccgaaaacaccgaaaaacacaccgcacttcggcttactctccgaactgctcgctatttggcgattacttgccaactcggaaacggctttacattgacctgttgtaatatcatatttggttttgaagattttgttcatattctttactcactatttgtttattcatctgttttttttggtttttgttgtgtttttatatttatagagcggttataaacctaagcggaaaattgctttgctttttaaggcatagcaaaaaaagacgaatgatattttcgccgaggggttgaaaagggaaaatggggatatttttaaaggttaataatataaaaaataggttgcagggcttgcaacaaggcgttagcctagactgtagactgtagactgtagactgtagactgtagactgtagactgtagactgtagactgtagactgtagactgtagactgtagactgtagactgtagactgtagactgtcatttttcctgttctattttatttgtcaagtaaaaattcttgctatcctatcctaaatttttatagaaagaaatgatttttttactttttatcctaacttgattgaggcgaacaattaaaatgtttgatattcaaagaggattaaatcatcaccgcactttttagcataacgaaaaatcctagctccctattgggtaagagttcacatttatatggctcgatcagataaaattgaacgcttaaaagtgcggtgcattttacagagatttcatttttctgttgttcttacgctgagaaatagcgataatgtgcgatctagaaaatccattgaagacttatgatagattatattttactgattattagtaccgcactgattaataactttgttctagttaaattcttaggactctgtccgtttatgggcgtttcaaaaaaaattgaaactgcgattggcatgggattagcgacaatgtttgtacttactgttgcctcgttgtgtgcttatttagttgagcgttatttactcactccactccatgcaaatttcttacgcaccttgatttttattcttgttatcgctgttgtcgtacaatttactgaaatggtcattcataaaacgagcccaacactttatcgtttactaggtatttttctccctttaattactactaattgtgcagttctcggtgttgcactcctcaatataaacttagcccataacttaactcaatccgtcatttatggattttccgcttcacttggcttttctcttgttcttgttctgtttgccgctttgcgtgaacgccttactgcggcagatattccacttccctttcgaggagcctctattgcgttaattaccgcaggattgatgtctcttgcttttatgggcttttccggtttagtgagagtttaagcaatggcaacattacattatgttctgctgattatcgttttacttgccgctctttttggggcaattttaggttttgcctcaattaaattaaaagttgaaggcgatcctattgtggaaaaaattgatgctttattgccacaaagtcaatgtgctcaatgcggttatcccggttgcaaaccttatgctcaagctattgcgaatggagatgaaatcactaagtgtgtacccggtgggcaaccattagtcatcaaaatagcagatttattaggcatagaagcacctagcggtaactttgagcaagatccgatccctaaagtagcattcattaatgaggaaatgtgtatcggttgtacaaaatgtattcaagcctgccctgttgatgccatcattggtacaaataaagcaatgcacaccattattgccgatctttgtactggctgtgaactttgtgttgcaccttgcccaacagattgtatttcaatgatcaacgtcaaacaacatattgataactgggattggaagttcgatcctaagttagttattcccatcgttgatactacttcagcacaaaagaaaatcgttgtaggagaatagggaatgacacaacatatagatattttaaccaattacaattcaggtaagttatgggatttttacggaggaagtcatcctccggaaatgaaatctcaatccaatcaaaaccctataaaaaacttgcctttagccaatacattttatgttccggtcaagcaacatgccggaagtgcgggtaatattttggttaaggtaggagatagagtcttaaaaggtcaagccttaacgcttggctcgggtttaaatgcattgcctgttcatgcccccacatcaggtattatcaaaaatattgccccctatgttgccgcacatccctcaggtctgtgcgaattaagtattgaaattgaagccgatggattggaacaatggcgaaatcgccaaccgatagaggactatctaactcttagccgagaacaactaattgataaaatttaccaagcgggtattgcaggattaggcggtgcggtttttccaaccgccgccaaaattcgatcagcaaacaataaagttaaactattaattattaatggtgcagaatgtgagccttatatcacttgtgatgatcgcctaatgcgtgactacagcgaagagattattgagggtatacgtattcttcgctatatcttacgccctgaaaaagcggtgattgcaattgaagataataaaccggaagctatcgcagtattgcgacaaagtttgcatggtgctgatgatattgatattcgtgttattccaactaaatatccttccggtgcagcaaagcaacttatccaaattctaacaggatttgaggtagcaagcggacaacgctcttccagtattggtattttaatgcacaatgtaggaacagcttttgccataaaacgtgccattattaatgatgaacctttaattgaacgagtagttaccttaaccggagataaaattgcacaaaaagggaatttttgggttcctttgggaacgccaatctcccatgtactaacacaagtcgcctatcaatatgattcacgtttccctgtttttatgggtgggcctatgatgggattcatcttaccgaatttatatgcccctgtaactaaagcgactaactgcttgctggcaccggatcattttgaatatgaaccgccggcaacggaacaatcttgtattcgttgctctgcttgctctgatgcctgccctgtacatttaatgcctcaacaactgtattggtttgccagagcagaggatcataaaaagtccgaagaatacgccctaaaagagtgtattgaatgtggtttatgtgcttatgtttgtccgagtcatattcctctcattcaatatttccgccaagaaaaagcaaaaatttgggaaattaaagaaaaggcacaaaaatcagaagaagccaaaattcgttttgaggctcgtcaagctcgcttagaaaaagaagaacaagaacgcagagcaagggttaataaagcggcagaaaaccgccgtgcagaaatggcacaacaaaaaggaattgatccagttcaagccgcacttgaacgcttaaaagcgaagaaatcaatcgaaacacgtgaacacaaccaagaacagaaaacgtttataaatattaaaggcgaaatattgcctgataacagcgacatcatagagcaacgtaaagcacgtcgtttggctcgtcagcaaaccaattcaaacagcattcaagaaattgaaactgttgtacaaaattcggagaaaaatacagaaaaaagtgcggtacaatctggcgtagatccgaaaaaagccgctgttgctgctgctattgctcgtgctaaagcaaaaaaacaggcttcacaaattactgcaaatagtatttcggagcctgatactacaacacaaaatacagaaaaaagtgcggtgcaatctggcgtagatccgaaaaaagccgctgttgccgctgctattgctcgtgctaaagcaaaaaaacaggcttcacaaattaatgcaaatagtattttggagcctgatactacaatacaaaatacagaaaaaagtgcggtgcaatctgacatagatccgaaaaaagccgctgttgccgctgctattgctcgtgctaaagcaaagcaattagcaaaaaaacaaattgaagttaccaataaatgaaacaaagagattttacatgtttaaaatgattagctccccacatactcattcggggaaattgacagcccgcataatgttatgggtgattgtggcaatgttaccggcaatcgcagggcaagtatattacttcggatttggcgttttaatccaatcactgttggcaataagtacggcgttatccctcgagtttgttgtaaccttattgcgtaaaaaaccaaaatttttttatattggtgattttagcgttgttttgaccgcacttattctcgcagttgccattccgccttatgccccctattgggttattattatcggtacctgttgtgctgtaattttaggtaaacatgtttacggcggattaggacaaaatttatttaatccagcaatggttggctatgtcattttgcttatttcatttcccctacaaatgacaacttggttacctccaattcaactgcttaacgaaccacctcattttgccgatgcgtataaactcattttccaaggtgttaccactgatggttttaatttaagccaattaatattggctattgacggtatgagccaagcaacgccattagacacagttaaaacagcgatgcggaacaatttatcttcattacacgaagtcagctcatcacctattttcagttcagttctaccattgggcaaaagggatattgttgaaggaatgggctggacacaaataaatttactcttttttctagggggtatcttcctaatttggaaaaaaattattcattggcaaattccaaccgcacttttagcaacaatttttagttttgcattgttgaactggttattttccccagtcacaccaaatcccatttggcatttagtcagcggtgctacaatgttcggtgcattctttattgccacagatcctgttaccgcctccattacaccgagaggaaaactcattttcggtgctttagtcggattattaatctgcttaattcgtttttggggaaattatcctgatggcgttgcttttgctattttactggcgaatatttgcgtgccgctaattgatcattacactcgtccacgtgttataggccataacaaaaaaggaatcaaacaatgagcgttacacaaataagtagaaaatatggcatattgttgggaacagtcgcctttatttgtaccgcactttccgttgccgtatattggcttacgaaagataaaattgcttttgcaatcgctaagcaagagaaaatgctgttagctgaagtaatgcctccagattattatgacaatgatctgttagccgattgcaaaatgctctcatcttctttggcaaaagaatatcgtattaataaactttgtacagcaaaaaaaaatcagcaaattagtgcttacgcttatgaaactatcgcaccggacggctactccggcaatataaaaatgttggtcgcaattacacgacaaggcgaagtgctgggcgttcgaattacggaacatcaagaaacccccggtctaggcgataaaattgaattacgaatttccgattgggtcctgaattttgcccataaaatgttacagccaaacaatttaaacgattgggcagtcaaaaaagacggcggtcaattcgatcaatttaccggtgctaccattacacctcgtgctgttgtaaatcaagttaaaacttctgggataatacttctaacacaacttgataaacttgctgtggagaatgaagaatgagtacaaaaaatctacccgaaacacaccgcactttagatgaatttgaaccctctcatttgactgtaaacaaggttaaaaccgaaagtgtatgggcaaatttatttaaacaaggattttggcataacaaccctgccctagttcagctattaggactctgccctttacttgcggtatcaaattcagcgacaaatgctttaggtttaggcattgcaactattatcgttttaatttgtagcaatactgtagtttctttgtttcgcaaacaaatccctcaagagatccgtatccccatttatgtgatgattattgcgactacggtaacgatagtgcaacttatcatgaatgcttatacttacaccctttatcaagcattaggtatttttattccattgattgtgaccaattgcattgtaattgggcgtgcggaagcatttgcctcaaaaaataccgttttacattccatttttgatgggtttgctatgggacttggtatgaccttcagtttgtttattttaggtgcattacgtgaaattttcggtacggggaaattattttttggtatagaaaatttatttggcgactgggcaaaatgtttacaactgaacctatttcaattagacaatagtttcttactggcaatcttaccgcccggagcgtttatcggtctaggcattatgttagcaataaaaaacgtgatagatcacagaaaatgaataaacaaaaacgtatcgaaatattaactcgtctgcgtgatcaaaatccgcaccccacgactgaattgcattttaatacaccttttgaattacttattgcagtcattctctctgcacaagcaacagataaaggagtaaataaagcaacggataaactttttcctttagctaataccccacaagccattttagatcttggtttggatgagttaaaaaaatatataaaaacgattgggttatacaatagtaaagctgaaaatattattaaaacttgccgtgatttaattgaaaagcacaatggtcaagttccggaaaatcgagaagcattggaagcactggcaggtgtaggcagaaaaacggctaatgttgttcttaatacagcttttggtcatcctactattgccgttgacacacatattttccgagtgtctaatcgtacgggatttgctcccggaaaagatgttataaaagtagaagaaaaattattgaaagttgtaccatcagagtttaaagtggatgtacaccactggttaattttacatggtcgctatacttgcattgcaagaaaaccgagatgtggctcttgtattattgaagacttatgtgaatttaaagaaaaaacagagatttaacataaattataaatagaaacgaaggtataacattatgacaaacaccccaaaaagacaaacttggtccagtcgattaacctatgtcatgacagtagccggagcaaccgttggatttggtgcaacttggcgatttccttatttagtaggtgaaaatggcggcggtgcttatgtactgctcttttgtattgccatgttagttatcggcattccaatgattttagtggaaaatgtcatcggtcgtcgcttacgtgttaattcaattgatgcattcagtgataaattagaaggaaaaaatatttctaaagcgtggaaaattattggctatatgggattactcggtgcatttggtattatggcgtactatatggtacttggtggttgggtaatgaattatatcatcaatctcattaccggttccctagatatttcatcggtaattaacaaagaatatgcccaaaatttttatcaagcgagtattactgaaagtccgctacaaatcataatttatacactgatttttgtcgtcattaactatattattcttgctaaaggaattattggcggcattgagcaagcggtaaaatatttgatgcccttattgtttatttgccttatcggtatggttattcgtaacgttactttaccgggagcaatggaaggaattatttattacctcaaacctgatttttctaaaatcacgccaaaattgtttatcctcgtacttggacaagttttctttgcactaagtttgggatttggtgtaattatcacactttccagttacctcagcaaagaagaaaatctcatccaaaccgccgttataaccggatttacaaatacaattatagctgtcctgtcaggctttatgattttcccgtcattatttacttttgggattgaaccgaatgcaggaccaaccttagttttccaaagtttacccattgttttctcacacttatgggcagggcgtatttttgctgttgtcttctttagcttactgctcatcgcagccctaacaacctcaatcaccatttatgaagtaattattaccgcactacaagaaaaacttagaatgcgtcgtgcaaaagcaatttttatcacgttaggcacaattttcttaatcggtaatattccatcaatattaagtgataatttgttaaaagacgtcacattctttggtaaaagtatcttcgatacgtttgactatgtcagcggtaatattttatttttattgaccgcacttgggtgtgctatttttgtaggctttgtactaaaagaagatgcgataaaagaactctcccaaaatccaaattctttattgactcagatttggttcaattatgtaaaatttgctgtaccattaattattatcgtgatttttgtaagtaattttgtttaatctaaaactgtttaatttatagaggacactatgcaccatatatttatctcagataaaaataatgatatccgtcgtcatcatattgaaaatgaaactaaaaaattagggattacccctaatttttatgatgcaattatggctcgtgatttatcaaaagaagaattatcaacgcttactatccctaatacatttttaaccccaggagaaatttgttgtgcaaaaagtcatctggaggggggggggtaaaacgattgttagaaagtaatcaagaatacatttttatttttgaagatgatattctcttttctgataactttacgcctgaagtcattaacgaaattacaaactttatatcctctttgcaaaatccatctattctcgttttatttaacagcatttataaaaagaaaaaagtaaaagatcttaatagtgctatatctattttttctgctcacaatttattctatgcttgtggctatgtcattaacagacaagcagcagaaaatattctaaacatccaaacgccaatcaagtttgaaattgatgcttttaagttttattactggttaggtgcctgcgatttatattgtctaaatactgacttagtaaaacccgctccagaaatttcaaacttatcagagatagattgcgacaaccctagaaaatatacaaagcaacgcacaattaagaaaaataacgcatatcgtcttttatacaaccaactgagttggcaaaataaattaaaagcaaatataaagagaatacaaaaaatgttacataaaccctttgaaaaattgtagtttgtaatacattctaaatgggtagctttgtaggcagaaatcaataatctaactttttaggttagattatttctgttatttactcctttaagatacctaaattccaattttctgctgacgttggacgtttttcttgcaataagaaacgttgatttgcttttgcttgaggttgtattactttacttgatggtgtagagaaagaaataccgcctttaagcaattgctgcatggttcccgtattaatggacaatccgctcaagccaatttccacaccgtacccggaagaaatccaaaactctgtattttggcgaacaaagtgttggtatttcttagcaattaataaatgaactaaaactcgatcacctaattgatttagttccagtttagatatagtacctacctctataccacgatacatcacaggggatccgatactgatgtttgtggcatcagtggcttccagaataattggaaagccgttgccgtatttgtttgccggaggtacggacgaaagcaaattaaagtttgttttttttgcaccttgtccaatttctacatcaatataaggttgtaataaactatcaatattatcaatgccaccggctgaaatgtgcggtgaaatgaggcgaaatttactgttttctttcgcaatgatattcatgtattttgcatgaattaatgcagtagcctcgattttatgatcttcggttagattaatttgctctatttctcctatagaaagccccatatagcgtagtgccatacctttagtcaagtttgttgcatcatcagcgataaacgtaataatttgtcctgccgacttagccttcatttcatttgcataaagggttttattgcttcctgagcctgaattatcaaagctgacagcacctttcaaagaacgggcaataggggttgcctgaatactaattccctttggcgttatatcaatttgtgccgcactttctacccaaaaaagacttttggttgtaagtaaatgtttatgtttggggtaaataaaaacatcaacttcaaaatgattagccgttggtctaatatctaaaatcttaccaacttcatattgacgataaagtacaagcgagcctttatttatacttggtagattttttgtagttaacgtgatattaggctctaaaatattatcggtaataccgaattctgcactggttaaatccttatacaaaggatattcttgttgtgcttgtccttcctttttaccgcttgatataaccctaattcccccttgcaaccattttttcggactagcagcttccattcttaagccatcaatacccaaactaatatcaaagttactcgctgcaataaataatgtatttttatgaataagttgacgatatttttccgctattgctacttggaaaataacgcgttccggtgtactggtaatgttgacaatttcaccaatattttggtgattatagtaaagtggttgcccttctgtaataccgtaggtttcgggtgaaatgaggtttattactagggtattgggttgtttgagtaaaagctcgttttctttaatgacatgaaaagtcgtttgtgcttctcccataccggcaataacatcaatgtattttcctcgcaaaaaatttttcacatcggttaaatcgccgagcgaaagtctttgatcacgtaaaacaagaattgagcctgttttaaacaaatatttcatattcggatcaactaataatttcccgtgtaaaattttttcgctattttctaccgcacttaattcagataacacgccaatttgtatatcttgcgaatagattttagtgtgtccagcatctaatcctgctacattaggaacaataacgttgatttccgtacctcttttagcagcttgaatattttcatataacgtatagtgtgcattattttcagctctaggactttctcttggagaatcaaatgcaacagccccctgtactattgcgtttaagctatctgcttgaatattgatacctgataaacttaaatttgcgttgattccggtaatgttccaaaaatgactgtcttttttgacaaagtgagaataggctttgttgatgataacatcaacttcaacttttttctgatctttcgtgaaccggtaatcggcaatttgtcccacaggaatttttttaaagtaaaccgaggctccgctggataaagaacccaaatcatctgccagtaaatgaattaacaaatcaccatcattaacttgtgttaatggagcttcggtttccgcaataaacgtattttccggcttaccatcgccgggttgtaatgtgatataattaccagaaactaaagcatcaattccggagattcccgccaaagaagcactaggctgcactaaccaaaattttgtattttccttgaggatgctttttgcctccggataaatatttgctaatacttccacttttttgagatcatcagtgaaatttactttttttactacgccaatttgtaacccttgatagcgaatttgtgtttttccggcaactaaaccggctccattcacaaaagttatcttaatactttccccttgctctttaataatctgaaagaacaaaagtgtacagatacataatgcaataaagggcagtaaccaaaaaggcgatatacgtttggtttgtttaatttgggctttcaattcttccattgtttctatttgattatctaattttttgtttgtcataaatattccaaagtaaacgactatcaaattgtgaagtcgacatcattgttaaaaataccgttgctccgaaataaaatgcggcaggacctactgaaaaatcaataagttgccctcttgttactaatgacatcatcagagcaagtacaaataagtcaagcatggaccaacgtcctacgaaatgtacaaaatggagcaagcgtatttgcaggtgaatcgaatgttgccatttaaaatgaatggagaacaaaagataacacataattaaaatcttactgaaaggaataaaaatactggccacaaatacaacaaatgctacaaagtagcttcctaaattgataaaggtcagaacgccggacattaatgtgtcttctgttgctataccgttcacataaactatcgacattggaagcaaattagcaggaataatcattacgaccgcagccaataaggttgcccaagttcgctgtaaatagacttcatctgaaaaatcaaggcgtgatagacaacgtgggcaaatggggcgtcgttttctatccgtatgacaatgattgaaagtatgttcacaatgcttgcacgcaataataggaagatttttttgttgtagcggagttttttggggataaaaatgccgccacaattcagcaggattgatttttataaataataatgtggtcaaaagtgcggtaaaaataaatgcaattaaatagctattaatatgtaggcttgcatattcttgtactttgaacatggttacgcccaaagcaactaaataaacatcaaacatcacccagggttttagataatttaacgttaacagtaagtgacgaggtctgatgtctaatagctgtgataaacgaagtaaaataactaataaagcaaagcttataggcataaataccgcacatagaaaaatcataaatgcagtgtaaggatagccttgaattgccattttccatataccttgccaaacagacgcatttactggcgtaccaagcaggttgatggttaataatgggtaccctaaggcaaacggcattaaaatcaaaatagtcaatgcgatgattgcacaacgtttcaaattccaaccggaagtgttttgcagtactttgtgacaacgaggacaattcgctgattgatttttttgtaataagccaacagaaactaacgcattacaatcagtgcaacttataaggcagtatttagcttgtgataaattagtttttttctgcatgttgtcttattgatgaataataaagaaaggctattctaacctaatttttatcggaaatactatttttcattatagtcataagagaaaagtgcggtcatttttagtgaaagtttcgtttcatttaagtattaattgtttatttttttttgttttaagctaaaatgtggcgagtttttttatctaaaaagtcattaagacaggaatatataacatgactgaaattcaaaaattaacaaataacaaagaaattattgcttacttagcagaaaagttcccattatgtttttcattggaaggtgaagcgaaaccattgaaaattggtttatttcaggatttggctgaagcgctagcaaacgatgaaaaagtgagtaaaactcaattacgccaagccttgcgtcaatatacttctaactggcgttatttacatggttgtcgtgccggtgcggtacgtgtggatttaaatggtgaacctgccggtattttagaacaagagcacgttgagcatgcagcagctaagttagcagaagctaaagcgaaagttgctgaaagacgtgcggttgaaaaagcaaataatccaaaagcaaataaaaaacgctctgtacatcattcagggaataagtcagaaaataagaaatcagctggaaagaaattctccaacccccgtcaagttgaacaaatttttgtcaacgttgatttagcaaatttacaaaaaggagatgtggtgagagttaaagcgggagataaaactactaaggctgagatattagaagtggttaaagagggtgcccgtgttgaattagagaatggattgatattaactgtaagtgcggatcgtttatttgcgtaattttataatacatggctaatttagtacctcatctcctctggtattattttcgtgtttaattattttaggaaagtgatctatgaaattacctcaacaactgcgttatttgctttgtttgctgtttggctttgttttaagtttaaattacgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaacgtatgcggataaaattgatgatgtgttaaatgagggaaaactagatattgcctttaatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggcctgaaattcaaacgaggttagttaaacgttataatttagctattcagcatctaagtaaagtaaagtctgatgatattgtacaattgtatttgaatgcttttgcaagagagatcgatccccataccagttatttggcacctcgcacagctaaaaatttcaatgaaaacatgaacttgtctcttgagggaataggtgcaactttacagtcagaagatggtgaaaccactataaaatcgcttgttcccggtgctccggcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaagcggctaaactaacagttgaaactgttgctggtaacaagatcgccatgattaaaattccggggttttataatggcttaactgaggatgtacgtaaattacttgctgaagttgaagctaaaaaagcggaagctttaatcattgatttacgtggaaatggtggcggttctttaccggaagctattgagttaaccggtttatttattactgacggtcctgtggttcaagtgcgggacgcacatcaacgtattcgtatatatgatgatcctgatacagagcaagtttattccggtcccttgcttgttatgattgaccgatttagtgcatccgcatcggagattttttcagctgcgatgcaagattataatcgagccattattcttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttaccttgggataaaattccatcagcgtcatattctgaagtcggtaatgcacgcctgccggtagatatattgaatcagaaacatcttgaacgtattgcgaaagaccctgagtttattgcactggatgaagatttaaagattcgtgatgaaagaaaaaaacgtaagtttttatcgttgaactttgctcaaagaaaagctgaaaatgataaagatgatgaaaaacgcttgaaagatcttaatgctcgtttcaaacgagaagggaaaaaaccactaaaagatcttgaagctttgccgaaagattatgaggatcctgatttttatttaaaagaagctcagaagattgcggtagatttaattgaatttaataaaaaaatggctgagtaaaataagatttaaaatatccgcacttttgaaaagtgcggtcttttttgttatctaaggaactaaaatgcgaaaaattaaagttatcttattaatcttattattaggcactacgactcatatttatgcacaacaaaagtttacttctgtagatgagattaataacattactttaagtaaatcacaattattgtttgaattagatttattggaacaacaactatccgaggaatatcagcctagattatatgaacaattacattctttgctcagaaatatagatttacaatttaaaactacaattggtcgtatttatgttgaaaatgactatgcattgctttgggaagataagcaagctgaaaaaatgtttttacgtgaatatgccgcaatagttgcaagcggagtctctgaaagagcggcaagattattgaatgatatttataaagcatctgaaataggagggttagtttatgatatgttgctgaccgacgcatttttggattatatgtattattcaaaaaatgcaaaaaattttgcacaacagtggttctactcaacgaatagctacaaagctcaattgccatcaaaacaagatattcaacgatggctatcatcaataaaacataatgaaaatttgatgttcatcgaacaattagctcaacataatgagcaatatgagaaaattataacttacctgagtaaattaataccccaagatgacaagtcaatattatacaaattagcaattaatgcacagcgtttaaggattattcctgattttaacaacggtatttttgttaatattccaagttatcaattaaattattatagagatggagaattagttttaaactctaaagtcattgtcggtaaaaaagcacgtaaaacaccggtaatgtatagtaagctaagtaatattgttgttaatccgccttggatacctactcctcgtttaattaatgaagatatcgtgccaaagattaaacttgatccggattatgttgctcgtaatagttataccataagtgatagcaaggggcaggttatagatccttcttcaataaattggaatactataggcactaattttccctatcgaatccgccaagctccgggaggaagtgcattaggaaactataaatttaatatgcccagttcagatgcaatttatttacacgatacaccaaatagaggattatttagcaaaaaaaatagagcattaagttcaggttgtgttcgtgtagaaaagtcagatcaactggcgacaattttattaacagaagccggttggacagaagaacgtaagcaaaacgtgcttaatagtaaaaaaaatacttcggagaatattcgctccgataatcctgtatatttatattatgttactacttgggttgaaaacgatgtcgtgaaaacattacctgatatttatgagtatgatcaagtacctcatttaacttatattaactggaatattattaaatggtatctaaattaaaatgtgagcagcaagaactaaatattatgtttgctgtcgaaagcaaatcatttagcactttataacgaaatattatatgaatgaaattaatcaaaatcgtcgcaaatggctatctttaggagggattattcttagtgcagccttgttacctcaaagtgttttagccgtattaccgaagccttctaaatctaaatttttatcttttagaaacatcaatactggagagagatttcgtggtgaattttttgccaataaaggtttttccagctctgatttgaaaaaaatagatcatttaatgcgagataaacgcaataatcaaattcataaaatggatcccaagttatttcataaatttgttcatattcaaaacaacttaggtttgcaaaattctgaaattcaaattatttgcgggtatcgttctccggcgagtaattccgccatgctacgtagtggtcgaggtgtcgcacgtaacagctatcatactcgtggacaagcaattgattttcgcattgagggggtttcattagcgaaacttcgtcaaacagcagaaaatttgaaaaatggcggtgttggttactatcctcgcagcaattttattcatgtggatacggggccagttcgtacttggcgaggtagctaaaatactaaacgtaatatagttgaccgcactttattcaaagtgcggttttattatttaaataaataaggaaatgatatgaatattgaaattgtgccggtaacggcatttcagcaaaattgttcaatcatttgggataataacaaaagtgcggctattattgatcccggtggtgaagcgacaaaattaattaaacgcattgaagaattaggcttaaatcttgaattgatcttactgacccatggacatattgatcatgtcggagccgcactgaagttaaaacaatattttaatgtagaaatttggggttctaatgaaaaagatgattttttatttaatagcttaccacaacaatctgagcaatttggcttactttttgagactgaggtatttaaacctgatagatggttaaatcaggagtatgaaattgtccgtattggggaaatgaattttgaagtattgcatcttccggggcatactcccggtcatgtcggttttatcgaatatagtaaaaaaattgcttttaccggagatgttttgttccaaaatagtatcggaagaacagactttccaagaggaaatcatactgaattaattcaatctattcgtgacaagttatggaagttagatgatgatatgattattatttcaggacatggtaattatacaaccataggaaaagagaaaaaatacaatccttatatccgctaaaagttaagatgcaaattatgttattgatttacacttaaaggacaattcactagaatagtcaacatttattaatttatcttgaattctataaaggtagcaaaatgattgatccaactttattacgcaataatctttctgaaattgcggaaaaattaaaagtaagacgtggctttattctcgacgtagataaattttcacaattagaagaacaacgtaagactttacaaattaaaacggaaactttacaagccgaacgtaactctcgctcaaaaacaattggtgcggcaaaagctagaggagaagatatttctactttattggcagaagttgatcatatgggagccgaattaaatactgtcaaagaagaattagcgaatgtattaacggaaattgagcaattggcattaacaattcccaatattcctgctgatgaagtacctttaggaaaagatgattctgataataaagaagtttttcgttggggaacaccaaaaaaatttgatttcgaagtgaaagatcatgttgccttaggggaaatattaggtgggttagattttgctgctggtgttaaattaagtggtgctcgttttgccgtaataaaagggcaaattgcaagaatgcatcgagccttggcacagtttatgctagatttacatactgagcaacatggctatacagaggcttatgtaccttatttagtcaatcatacaacactttatggaacggggcagttaccaaaatttggtgaggagttatttcatataaaacccctagaaaatgaacagacttatgcgttaatccctaccgccgaagtgcctgtaacaaacttagttcgagatgaaatcatcgatgaagctgatttaccaataaaaatgaccgcacatacgccttgtttccgttctgaagcaggttcttacggtcgtgatactcgaggtttaatccgtatgcatcaatttgataaggttgaattagtacaaattgttgaaccggaaaaatcaatggaagcactggaagaattgacaaatcaggcagaaaaagtattacaacttttaaatttaccttatcgtaaagttttattgtgtacaggcgacatgggattcggagctactaaaacatatgatttggaagtgtggattccggcacaaaatacgtatcgtgagatttcttcttgctcaaatatgtgggatttccaagcacgtcgtatgcaagcccgttgtcgtgcaaaaggcgataaaaaaacacgcttagtacatactttaaatggatcgggactagctgttggccgcactttagttgccattcttgaaaattatcaaaatgcagatggctctattaccgtaccggaagtattacgcccttatatgaatggaatagaaattattggtaaataatctgttgccgaaagataacaacgctccttttgggagcgttatctcatcaagccaaacctgtcataatcttactctcaaagaaatcataatctactaaaaaagcatcatgtccataatctgaaggaaattcataataatttaaatcaacgccgctttgctccaataatgctttacttttatgtagatcggtcaatttaaacagctgatcagtagtaactgcaaccaaagtatagcgtgcttttatacgacttaatgcagccttaatgtccttatagttccaagccggatcatataaatctaaagcccgcaataaatgcacatagctattggcatcaaaacgttccaaaaattttttcccttgataagttaaataagattcaacttggaaataatctccccaatacagactttccgcttttttagctcgtccaaacgctttttctaattgaaaatcggtacgataggtcagcatacccaacattctcgcaatagataaccctttacttggaggcagtctgtcataataatctccattattaaaatgaggatcattaataatcgcttgacgcatcacatgattaaacccgattgcctccgcacttaaataaagtgacgaacaaagattaaccactctgctaacgcaatcaggataatcaatagcccattgtgtcgcttgcattcccccgaacgatccaccaatcacagcataaagttttgctatatccaatgtattcagcagttctcgctgaactttcaccatatcttgtacaataatatgcggaaactgactaccgtaaggtttatttgtatcaggattaatggacgaaggacctgttgtccctttacagccgcccaatacattagaacaaataaaaaaatatttactcgtatcaagtgccaatccctcccccataaaactctgccaccaaccattttgcgatttatcagcaaaatagggttcagcatcgccggtcaaagcatgacaaattaaaatgacattgctcttatctttatttaaagtaccataagtctgataagcaacttcaatattttttaattgcccaccttgtactaacatcaagggataatcggtaaaaagcgttaaagtttgtacagccatgtaaatttctcaaaaatcttaataaaaagcaccgcactttataaaagcaacccatgtaaactactcatactctgtttcattgtcaaggaatttttagccatccaaacatctagacagccaataaaatttacttgaaattacccgcttttttcattattttgtagcctccgaacgaggcagctataaaatgaacttagatttcacacaactttcttttccacaatggataataacactcgtcaagcgattactacattacggctttgctttcagcatttttacatttttttcccttattatcattgatcgttgcatagcttggtatgttcaggacagaatttatacaaaaattgaagaacttccctcccgcccttatggtattgtattaggcacagcgaaatactttagtaaaaataatcccaatctctactacaacaatcgcctgactgctactgttgagctttttaaacaagagaaaattgattatttattattgagtggtgataacagaacaatgcaatacaatgaacccataaccatgtttaaagatttgcgaaaaatggatattccggaagatgttatgtatatggattttgccggttttagaacgttagattccgtcattcgtgcagataaagtctttaaagcacagcccatgacaattattacccaacaatttcactgcgaacgggccttatttatcgcaaaattctacgatattgatgctatctgctttgcggcaaaatcacctgccaactacttatctgtacgaatgagagaattatttgcaagagtaaaagcgattttagatattgtattagaaaaagagccttattttttgggaaatccagaaccgctcccgacgccaataactcaattatgatcttcgctaaataatctagtaagcttataaaaaagacaataaagttaaaaatcccatcagacaacatattattttccaaccattttctaccgcacttttgacaaaacatttattaatcacgaacaagtaaaaattttaaggttttacacagacttatatttgtcaagattgaaaaaagaaaaaaaacagaaaaattttaaaaaaaacttctagacttaatgtaaccatttgaaaaataataaaatgtcattttacaaccaattttatatgaggatatggaaaccctagattttacaaggtttaagcgaaataaatcttgaataatttacagagttatccacaggttatgtggatagtaatttgcatgaaaaaatttttactataataaaaaaatcctgttgacaagcatacaccagatcattatcatacgcacctctccttatgagaccatatttatggtatttttcctccttagttcagtcggtagaacggcggactgttaatccgtatgtcgctggttcaagtccagcaggaggagccagttttttcttttgggttgtttttatttgtctccttttataaaaactcaatttaccaaaagactttaagcccatttagatcttctccttgtatgggcttttattttttcttttctatattcaaatttctcgaaatttattttatactcgctactttcacacttcatttatatctcgtttaggttcaaatatgttattccctatactcgctattatttcaggtttaattattttagtttggagtgctgatcgttttattgacggtgctgcatcgctggctcgtttcctcggtatgtccgcattattgatcggcattatcattgttggttttggaacatctgcccctgaaatgatcgtttctgccctttccgctttaaatggaaatcccgggcttgctttaggtaatgcttatggttcaaatattggtaatattgccctaattttaggtttaaccgccttaatcaaacctgttatagttaattcgctggttttaaaacaagaattacccattttaactttcgtcacttcagtttctgcttacttaatttatgatgctgaaatttctcatttagatgcaattattttacttgttatttttgctatatacatggcttggagtatttggcaaagcaaaagatcagcacaagacagttttgccgaagatgtaacaacagaattggaagaaaaaaaaaccatatcagtaaaattagcagtattctggatgattacgggattgattttactaatgggaagctcacaattattggtgtggggagctgttcaaattgcttctcaattaggtgtgagtgatttagtgatcggtcttactattgtagcaattggcacttcattacctgagttagcagcctcaatcatggcggctcgtaaaggtgaagtagatcttgcggttggtaatattattggttctaatttatttaataccttagctgtcgttggcatagctggcttaatttccccaattcaagtgagcaatgaaatatttactcgagatatgttagttatgggaggattaacgctctcactgttctttttcggctatggatctcatcaaaaaaatggctcgattaatcgtattgaaggcggtttattgataacaagttatatcgtctatacttatttcctcattaccaccgcactttaaacaataaattaattgggagattaatttctcccaattaacaaagctcccccacgtatcggtaaagttgtgccatacattaaactcaaggcaaaaaatataatcatcagaccagcaagtatcctgactaagatatgccaaaacttcttatgtgttgaaaaataaaaatgccctaactgaaccgcacttttccgtgcatacaacacaattaatgcaaaacctgacagcattaatccaacacctagtgacatcgctacagtagccaacattccccaaacatacaaatccaacatatacgacaaaaataggataaatattgctccagaacaaggacgcattccaatagtgaaaataaccaaacattgtgattttaaactctgtgcttgctgtaactgttgctgattaggtaaatgctgatgcccacaagaacaattatccgtatgctcatgaaatcttgacaaattttgtaccgcactttgcatacctattttattggtaggtattgaagagagcgtgaattgcttgatttttagcgactgactattttttttcaaaaaagacttgctcccttgccaaatccattgcaatcccaaaataatcatcaagaaataagctccacgttctaaccaaagctgacttaatttaaaatagctcgaggataactgtaaaatagccacaacaattaatgtcagggaaatcgccacaataccttgcattaaagaagcaaaaaaagttaatttcatactggttttgagctgggattgatgggttgctaaataactaccaataataaactttccatgaccaggacctaacgcatggagaacaccataaataaaactcaccacaattaatcccattcctgcataaacaggggcttgttttacttgatgcaagtaacttgaaagtaattgattaaattctctctgccaaattaaaacgtgtgaaaataaatatgataacaaataaatgccacctaacgataaaaatacaagcaataatataagtttataggttctttttattgacattggataactactttttgtgcaaatataacgcctaacgagctgtcttcatcacgttggttacgatctaaagaggcagcatattctcgtaatttttgatcaacttgaggttcgacaacatttccttgacaatgttgcggaagtgacgaaaaatctaccgcacttttctccttgtctttatcgtaatacatagatacatagtaggttgaatcataagtagataattcaaaaaggttattggataactcctgaggtttagctaataaaaaatcaaaaaaatataaaacttgtgcaccgttagattttaatccatagttttgaggaattgcagaatacttaattttatttcctttcttatcatacaaataactaaaataatgttcattaacaacattttggatcatatcatcaataaatttttgtaattctttttgatcatcttgcaaaaaagccaaatcatataaaatagcagatgaacttgattcatctaaaatccattgcatagaaaaaccaactaatttttgcttgtcaataatgggttttgtctgcatttcaataaaagcgtgtgggtgagctaaactgtatataggcaaaaaaccaagaatgatcccgaataaacgaatgaattgttgcatattcttccaatcaaataactaagtacgcattatgctatcacaatatagcgttgatttttatcttttcaaaaaaatcatgagaagttgagtttgcggaaattaagccccctaaagaacagagttttacggcaccgtcagataaaaaacttacggattatcacacataaagctaacaaaaatcagtaaaagtgcggtacaattcgcaagtttttcacttttaaaacgtggcttatgaactatcaaacatacattcctgatgaatatactatgtgtcaatttggtaaaaagttgatacatagtattgctcaaatcaaaagtaacaaaggaataaccctttatttacaaggtgatttaggagcaggaaaaactacgttaagtcgaggaatgatccaaggtataggacataccggtcatgttaaaagccctacttataccttagttgaagaatatcatcttgatgaaaaagatatttatcatttcgatctttaccgccttagcgatcctgaagaattggaatttatgggcattcgagattactttaatgaaagatccatttgcttaatcgaatgggcagaaaaagggcaaggcatattacctgagcctgatttaatcgttcatatcaattactttgatgatgcacgtagtattgaattacactctatatcagaacaaggccatttaattattcaacaattagtttaaaccatgaattacttacaacgcttgattttcattattttagcgattttcgcctttaatcatgcttttgctcacgtttggacaattgccatcgatcccggacatgggggaaaagaccccggtgctattggacgtcgtctcaatatctatgaaaaaaatgttaccctttccattgctcgtgaactaaagaaattgttagataaagatcctcactttcgtgccgtactcacacgagaaggcgattattatatttcagtctctaaacgctcggaaatcgcacgtaaacataaggcaaattatctcatctccattcatgccgattcatctgaatcaagtttgttacgtggtgcatcggtttgggttttatccaatcgccgagccaatagcgaaatgggacaatggctggaagatcatgaaaaacgttccgaattgttaggcggtgctggtgatgtcttagcttcacataaagaaaaatatctagataaaactgtattggatctgcaatttggacatagccagcgtgttagttatgaacttggttcagttgttttacgtcactttgctcgtatcgcaaaattaagtcgtagcacaccgcaacatgccagtttaggcgttttacgttcccctgatattccgtctattttggttgaaacaggttttctttccaatgcagaagaagaaaaaaaattaaatacccttgcctaccgtaaaaaattggcaaaagttatttatgatagtttagtagaatatcgcaaacgcaatttaaaagtagatctcaataccacaaagaatacccgccaaactaaaccaaaaaccaacagtgcggtagataatacaaataaaacacccgttaaagacagcggtattcgtcataaagtaaaagcaggcgaaggattaacgagattagcaagaatctataaagtgaatattaaagatattatcagtttaaataaactcaatcgtaatcaactttggcttggtgaaataataaaaattcctgctaacaatgaaaatacaccaaaagagaaagagaaagcgaaagagaaaaagaaagctaaagataaaaatgcaacattccatgtagtgaaaaaaaatcaaacactctatgcaatttcacgtcaatacaacattcctgtgaaaactttgctcaaactcaatcccaaactaaaagatggcaaagtacaaacagggcaaaaaattaaattacgtgaataagggctaagcaaacgtatgacaattaaaattcttcctccacaactggctaaccaaatagcggcgggcgaagtggtagagcgtccggcttctgtcgtcaaagaactgattgaaaacagcttggatgcaggagcgacacacattcaaattgagattgaaaatggtggtgcaaatttaattcgtattcgtgacaacggcataggaattgcaaaagatgaactccatttagctcttgctcgccacgcaacaagcaagatcgccagccttgatgatcttgaaatgattttaagtttaggctttcgtggcgaagcactcgcaagtatcagttcagtttcccgtttaaccttaacctctcgtacagcacaacaaaatgaagcatggcaggtttatgcacaaggtcgagatatggaaaccagcatcacacccgcttctcatccgattggcacaacagttgaagtagcaaatttgttttttaatacgcctgccagacgcaaatttttacgtacagacaaaactgaatttgcacatattgatgaagtaatccgccgtatagcgttggcaaaacctcaagttgcttttacgttgacccataacaataaattaatacaccgctataaaagtgcggtaacaaatgagcaaaaaattaagcgtattgcgactatttgtggcaatgattttatgcaaaatgcgttacatattgattggaaacataatgatctacatctttccggctgggttatacaacctcagtttgctcgtcatcaaaatgacctcaattattgttatatcaatggcagaatggtgaaagataaagtgattactcatgctattcgtcaagcttattcagaatatctgagcaatgaaaaatatccggcatttgtattgtttattgatctcaatccgaatgaagtagatgtaaacgtacacccaaccaagcatgaagttcgctttcatcaagctcgtctaattcacgattttatttatcaaggcatgacaaatgcactcacctctgaacaaaccaatattccaatacagagtgaacaatccaatccaaccaaagttgccgaacctcaaggtatttggaacttgaccacgcataacaaaggtaatcgagcgactgccggcaaaaatatttttgcccagcaacctaaagattatgataaaaaatcgtctcaatttaaaccgcactttgcagcaaattacagcgaagtaacgccaaagaaagcagtgcaaaaagcctatgcagaattactcgcaacacatgaagaaaaaactatcgcctcttctactctaccccatcaatttacacacaatgcaacgcatatcagcgaacagaaaaatgttttacatgcacttgcattaattgaaaataaggcattgttattgcaacaaaaccagcaatatttcctcctttctattcaggcattgcagcatttcaatatccgcttacagttgcaacaaagtaatattgcacaacaaacattgcttattccgattttattgcgtttaaataaacaacaatatcaatcttggcaacagcaagctctattttttcaacaaagcggtttcgattttacagacaattctgcacaacgcagaataactctaaaccgtttacctatttgcttgcgtacacaaaatatacaaaaaataattttacagttattggatcaacctcatgaaaaatacactatttttcttaccgcactttgctcacacttggaatttccctcgctcagtactttctccgaagctgtaaatttactcacaaaaactgagcaacaattttcaacccaacatcaactagaattccaatctttattagtcaaaatagagtgggatcactatttagataaattgcaatgaataaaaaatcaactgctatctttttaatggggccaaccgcttccggcaaaaccgacctcgctatccaattacatcaagaacttcctgttgaagtcatcagtgtcgattcagctttaatttataaaggcatggacattggtacagcaaagcccaatgcacaagaattagcactaacacctcatcgcctaattgatattaaagatccaagtgaaaactattctgccgcagaatttcgccgagatgccttgcgagaaatgcaaaaaatcacgcaacaaggaaaaattccgcttcttgttggcggtacaatgttgtattacaaagccttattggaaggactttcaccgcttccttcagcggatgaaaaagtgcggttggaaatagaacaaaaagcagaaaaatttggttgggcaacactacacaacgaattagccaaaatcgacccaatatcagcacaacgtataaatcccaacgacagccagcgaattaatcgtgcattggaggtcttctatttaacaggacaatctttaacagaattaaccgcacaaaaaggcgaagaaattccttatcacatcatacattttgctatcgcacctgaacgagctgttttgcaccaacgcattgaacaacgttttcataaaatgatcgaacaaggctttcaacaggaagtcgaaaaactttatcaacgctcggatctacaccctaacctaccctctattcgttgtgtcggttatcgacaaatgtgggaatatttacagggtaattatggtaaagacgaaatgatatttagaggtatttgtgccacaaggcaattagcaaagcgacaacttacatggttgcgtggttggaaatcgcccatagaatggctagacagcttaaacccaaaaagtgcgaaagaaaaaatcataaaaactataaaacataactgtaaataaagttcacaaaatcgtttttttctataaaaatttaggataaaatggctcgaatttttacttgacaaataaaatagaaccgaagaaatgacagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctannnnnnncagcctacagcctacagcctacagcctacagcctacagcctacagcctacagcctacagcctacagcctacagcctacagcctacagcctacagcctacagcctacagcctacagcctacagcctacagcctacagcctacagcctacagcctacagcctagtatattgcctaaaatcaaccttgcaaggtaaatttgtgaggttggacatgttcaaacaacatcttaaaaatcacctatttcaacctcaacctttcggcgaaagtattattcgcctttttttgttgtgtcttaaaaagcaaggcatcgccgatttatttatcaatctatctaaaaagtaacacgtttaatcaataaacaaccgtaaaaaagttaaaaaaatcaacaaaataaatcaataaaaaaacctaattttaaaagcttaaagagagtgaatttatgaacaaaatcttcaaaaccaaatacgatgtaacaacgggtcaaacgaaagttgtgtctgaattagcgaataaccgtcaagtggcgagccgtgttgaggcgacggagagtaagccgaagtgcggtgtgtttttaggcatgtttaaggtgttgccgttggcgttggtggtgtcggtagctctctcatcaaatacttttgctgcatggataggcacttatggaggtactgtaggttcagaaaaaagagaaatggaatatatttataaaggtagggataaatatagattacatggagttgctttgaatccttcaggaaataataatggctcaaattattctaaagttagtataggaggtgtggctgtaggacatgatgcttgggcatcaggggataattcaacaggtgttggggcagacgcacacgctataggtatgcagtctgtggtagtgggtaataattctggagctaacaatcagtctgtcgctataggaagtgacgtatttgcttatggtaaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggggttgggacaaatgtacataaagaaaactcaatcgctttaggaacgggcacaacagtaacaggtgcgggcgttgtggctatcggttccggcgttggtgtaacaaaagacaatacaatagctgtgggttatggagcattgggaaaatcaggagaaagtattgttttaggtaattcagcaacattagaagagcatgcctcaaaatctatcgtgataggtaatggtgcaaaagttgaaaatacaaagaaagatgacacaattaaaaaactaagttggcctgaggatgaaaaatataggaatggtgaaaaagaattagaaatgtcggctattgctataggaactagtgcaacagctaacgctcaaaatagtgtagcgttcggaaatgaagctcaagtaagcatggaaaattctgtggcattagggaataaatcacatacaaaatatttctatcaagatgataataacaaaaacatagccacgctcatcggaaacggcaaaaatgatgcgattaatttagatccctatgttccagagggttctagctataacttaaaaactgataaagcggcgggtattgtgtccgtcggttggacaaaggataacagtagaaatcaagaactgggcttaagacggattgtcggggtggcaccgggtgcgttggattctgacgtggcgacgattggacaattaaaagccttagaatatgtaaaaagagaaggcttagtcgtttattatacggaagataatggaaaaatatataaattagttaaaggaacagatggaaaattctacaaggtcaataccaaaaatggcacaccattagataaacaagaaattccaaaagaaaaagtattagttggggctaaagggcataacgagaagatacaatacataaatgctgataaacaaattgcggacataggagaaaagataagattcgggcatttagccgatggagagatttccaacaaatccgatcaggcgattactggggcacaactttatgatcttaaaggtaagttggggttggaattagagaccaataatacacaattcaaaggacataattttacagcagttgaatatattgaaggaacacaaggatcgcaaaatacttttaaaggtgcaataacggaactgattaaagccgtcaataaaggttataagttcagtgatggaacgaaaactattgataagatttattttggctcaacgattgaaataaaaccagaagatatttctgataatggtactcaatataagagtaaaaatttaaaaacaaaagttgaaaaaaacagttcaaaggcacaattcaccatcggcttaaaagacgatccagaatttaatactgtaaaacttaccggcacccctacagagaacactcacgccgttaataaaaaatacgttgatgacaaactcaaagacgtggcttcaaatatccactttatgtcagtacatacaccgaccacaacaccaaaaacaaaaggcaattacaacaacgacggtgcaaaagttgagggggcgattgcgattggtgtggacgcaagtgccgcttctgaaaactccatcgctatgggtaaaggctcgaaaattgaggcggaaatatcgaacgccgtcgctatcggggcgaataatcatctcagagggaagaataaaggtcaagataagcatacggtggctattggttcagacaatatcatcaccggacgaaaagttgtgaatttaggttcggagaataagataggcagttctgaaaataattataaaactgacccatcagcaggtgcggtcagcatacgagtgatcggggataataatatcgttcgtggggtatggaataccgtcatcggtgaagagaataaatttacagattcctcagtctatgttcatttgatgggtgataaaaataccgtcacagattctaaaaataccatcatattaggcgataacaatattgtctcaaaattagcaaactctatcatcattggtaaaaacataactgctaaatctaatgttaaaaacgataataatttaatcgtcatgggtaaccaagcccaagcaacaaatgcgaataacagtgttgtgatcggtgcgtctgcaaaatctacagcgacaagtgcggttgtgattggacaaggtgccgaatccaaagcccaaagtgcggtagttttaggtaaaggggcgactgttcaagccaacgccaccggtgcagtagcgattggtgaaggggcgtctgtatctacaaatgctggtaattcgattgcgttagggaaaggatcgcaagcgacggctaaagcgaatgcaaaggcaaatgctactgtagagggcgtgaattttgcctttgcaggtgggactggaaataataagacagtattaagcataggtaaagctggaacagagcgtgtcattaaacacgtggcagcgggcgaagtgagcaaaatctcaacagatgctattaacggaagtcaattgttcagtgtgacaacagaatttgcaaaactggcaaaagatgtccttggggcggaattaggcacaactaatcaattcaaaaaatcagcatttaagacattaaaagccacaagtacgtctacggataccgcacaaaacaaaacatttagagaagcgattaatgcaaatatagaccaaattaataaaggcttggtatttagcgacggcacaacgcatggcacaagacagctgggcgaaaagatcaccatacaagccggtgttgttgatggtggcgattatgtcagcgataacatcaaaacgaattacggtaaggatcaaggagtattcctaattggaattaaaaaagctccacgttttgaaaaagtcacagtaactaaagatgttgaagacacaagtcctgaaatgaccttaaccacgaaaaaatatgtggacggaaaacttgccaatgtcgccgctaaatttaccgtcaagggcgatactaacggaacagacggcaaagggtatgaattaaataaagacaatacggaattgaatattaatggagatgctaaaaacatcaccacagaggtggataaaaccgctaaaaaattaacagtatcgcttaatagtgctttaacaggcattacatcgatcggaaaagacgagagtaacaaaatcacgtttaatggtggtacaactatcacagccggcggtgcagggttaactttagcgaatgagggtgacaaagttaaaatctcaaatgtggctgatggtacaactgctaatgatgcggtgaataaaagccaattggatacaaaacaagataaattgacaggtactatcaccgcaaataatgggctacaaattacatcgggagatggtaaaaatactgtcgctagtaacatcactttaggcttagaaactggcttaaaagacaaaatcgacaatgccttaagtaaaaccgaagcagggaatacctatgcgaaagtggatgcgtcgaatataaacaatggtaatcaaacagcatggagaaataaactagacgtctattctaaattggaaacaacgaatgaaatcgccaaagcgaaagaaacagtcacaaatggtgcaggaattacggttacagaaacggctgctggaaatggagctaaaacatttaaggttgcattagaaaatagttataaaacaaaaatagatgatataggtaccggaactgtatcagataaaaatgacaaaaccgtaacgggtggcaaagtacacgaagctattgaggcggcaaaaactgatataaaaggtaaactgtatgcaaacacagcaacatttggcttaaaaggtaatgatagtcaagaagttaaaaagacactaaataatagtatagaaatcaaaggaagtgaaacggctagaactagtggcacaaatatttatgtatcaaaaaatgatgaaaacggtctaaaaatcgaattgggtgaaacgttaaaaggaataacttcgattactaagggcgataataagtctaaaatcgactttaaagatgacagtattgatttaacgccagttaatggaaaaactgtctctataacaaaagacggtaaaatcagcggcttatcagatggtcaaattgagaacgcctcaaaagacgtggtcacaggaaatcaattgcatgatctagcgggtaaattaggcgttagtgtggatacaaattctaaaaccggttttaccgcaccgtcgtttgtcgccgtcaattatcaagggcaaacagaaactaacggaaaaaccacctttaaagaagcaatcaatgatttgatcgtggctgtgaataaggggtttgtaattagtgatggaaccgataatggaacgcttaatctaggagatacattacaaattaaagcgggtaatatcgataaacctgatgcacaaaccttaggatttaccagcgataacattaaaacaaaatatttatcaaataaaaaagaagtgttaatcgggattaaagaaaatccgaatttcaaaacggtaacagtaactgacacaattgatgaaaaaacgccggaaaatacgttgatcacgaaaaaatatgttgatgaaaaattagccactaaagcagggacatttaacgtgagttcggataaaggtgacacaaacaatatcaccggcactttatctgtcaaaggtaaagaagatgatgctaatggcaaacataaaaatattaaaacagaagcgacaggatcgaatttaacgatagcacttaatagcgacttaaaaggtatatcgactattggaaaagatgataaggctaagattagctttaataaagatactgctaaaaatgagatcgagtttagtttgggagataacacgaaatataaattcgatgagaatggattagacttaggaggtaaaaaaatcaccgcacttgcgagcggtttagggttgaaagatgctggtactggaaacggaaatgccgacattattaaaaaagtcctcgagggaactcttgataatggcagtaacattaaatccactaacgccgtcaatgtaaaagacctttccgaagtcgccaaagcccttgtggaaaaaggactatcctttgagggtaatggtggttcttctgataaagtcacacgcaaactcggcgacactttgaaaattgtgggcaaaggaagtggtgctaactcaataacaaccactgaaaataatattaaagtgtctaaaaatacagcaaacgatggactggaaattggcttgtctgatactttaataggtattaaatctgttggtaatggcgataatgcgaaaattactttaagcggaagtaatggaagcaaggacaaaattaccttcaaagcaggtagttcagaggttaccctagccgatggtaaatttagcggcgtgtctgaaattaataaagaatcaggcaaagctgcgttgaaacttgaagccgacaaagcgaccttagaaagtgctagcggtaattccaaagtggaattaaaagataaagcagtaacaattacagctaaagaggataaaggatcgttaaaactcaccgaaaacactgcaaccttagaaagtgcgaaagacggttcaaacctggcattggataataccagtgcaacgttaagtgcgggtaaaaataagggcagtattaaagttaccaatggagcggataacaaaattgagttaagtccggaaaacggctcaaccgttacgttgaaaaaagacatgacaaatggcggagtgcaagccaccggcttgtctaccatcggtaaagatgagaataacgctttagtgtttaaaaacggtacgagtggcacgaacacggcagagttaaaagtgggtggtgcgactttgaccttcacgcctactggaaatggaataagtggaactaaccaaacagtgaaaatctctaatgttgcgactggtaagatagaaagtggttcatcagaagccatcactggcggacaactttccgatttagcaagtaaattgggggttgaggttgacagtgggaaaactgcgtttacagcactatcatttaatccgataaaaggcggtactaaagacactactagtggcacgactgcggctgccccaacaacctttaaagaagctattacacagttaattaccgccgtgaatggtggcttgacctttaaagggaatgatacttcccaaagtaaaaccacattacaattaggtggaacattgaccattgatagttcgagtgctggtagtgaaaaagacattacagcaaaactggaaccgtctaatggtagtgatcctaaagataacggtaaattaacgctgacgttaaataaagctacttctgtagataaaaatgacgaaaaagtcattacctcaaaagccgtagcaactgagctggaaaaatatacgaaaactgctgatttaggtaatacgtatttgaaaatagacgggtcgaatattggtggtgcttcaggtaaacaaaaatttggtagcaatgtcggtattgctgaaatcaaacttggcgaaactgacaagagcgacactgaattggtacaagctaaagctttaatcagctatctaaaaggtacaggtcaaaaatccgttaaagtatccgataatccagaaactaaggctgaaggagactattctattgctattggcgataaagcggtagcacaaaatgaaggtgcaattgctatcggttatggtgctaatgctaaaaatagaaacgcacttgccataggcagagatagtgaggtattgggcgagcatgctacggctatcggctacaaaaataatgtatcacgcaatcattccggtgcattcgggaaacaaaacacggttaaaggagatcattcctatgctgtgggtgcttataatacgctagctggcgaacacacttatgtcttgggttcaaatatcacgacagacgacaaagtaaaaaatgctgttatcttaggtaataactcaaaaggtgagaaagatgcggtatctgtgggtagtgatacgcaacaaagacgaattgtttatgttgccgatccaacgagtaaatatgatgctgtgaataaacaatatgtcgatgcacttggattaaaattcaaaggtaatgatgataaaaatatacacagaaaattatcagaaacattagaaatagttggtaagggattaaataaaaaccaaactactaaatttaatggcacaaatggaaatattgccgttaaatcaagtaatggtaaagataaaaaattagaaatatctcttaatgagaaattatcaaatattaaaacaatagaaaataaaggtagttcaatagaatttaatgcaaatgataaaaatggatctagcaaaacaattaaaaatttacttcttacaggaaatggaacaaaaatggttctttcttacaaaggagtacatttaaatgaaaaacaattgattggactaaaaagtggactattagaaaaacacaacggagaagataaagatagaaaagatttagactatttaatagaaaatgttgataaattatctattaaaacgcatgcagttaatgtaggagatttagctaaaatttctaaggaaatagttgaaaaagggtataaatataacgctgatattccgtcaggtaatagcaatgataccagcataaaactaggctcaactatatctattgttaaattatccggtacatcaacaaatggagtaataacatcttcacaaccgagtacacctacaataaatattggagactataaaggagataacctaatcactcgatatactaacgagagtggaaacgccaagatcgaaatcgggtttaaagacgcaccgatgtttagcaaagtgacactttctacaccgcaaatttatggtaatggtacaggtagcggaaatgctgttagtgataacgatttgatcaccaagtcctaccttgatgctgcattaaaagactttaagtttaatgtggaatatggtgataagaaagtccaaatcggtcgcaacgacaccttgaaatttgcagatgggctgaatattaaattagagttagcccaaaatggtactacaaaaccaagtgcgggtagttctgctacatcgatgacggcaccaactacaagcactccatcaagtagtgcagttggatcaattggtggagatagtgcaggtagcacaagcactacaacaacatcaaattcttcttcaagcactgctcagtcaaatggtgcaggtacaaatggcaaaagtggtacaagcagtacagcttcgtcaggagctactccaagtacgacaacagccggcacagcaagcagtacaacatcgaacactacagcggtggtgacgattggtacgactgaggacttgacaggcttgaaatctgccgagtttaacggcgataacggtaacacgactcacattaccggcaatgaaattgtgttgaaagatcaggcaggtaacgctcatacacaaacggcgacatcgcaaatcatcacggataatacagatcccgataaggaaaaagcggttgtgacaacggctgagggcgtgacaatgtctgtggtcagcgatgatcaggttttggtcaatgatcaaacagcagaagcgaatgttttaagcaatggcaagcacacaaccgaggtgaaagccggtgaggttgctattaaggacaaggctggtaaagatgtcgtgagcttgaaagtggctgacggtgaggacggtcaagatggcaagggagctacgctggcgtttgctaaaggcactgacggtaaatcgggcactggcgtaatcacgggcttgaaagacctagatgccacggctgacggttcaagtgcggcgaataaaaactatgtggatgaaaaagtgtccgacttagatagcaatcgtccgtttaacttctacatccaagagggcgatgactataccaaagtcgtgaaaggacgtgatggtaagttctatgatcctaaagatttagagggggcgaagtatgatgcagaaagtaaaaaatatacttctcaagatggacaagaagttacaccagaatcggataaagtcattattcgtgccgaaccgactgccgcacctatcgggatgaataacgtagcgagtggtttgggactggcagatcctgaaactgatcctaaaaaagttgaagaagcgaaagcagaaacggcgaaattagaaaaagatgtgacggataaaaaagcagccgtcagcgagaaagccaaagcactttctgagcaagcgaaaaaagccactgattggatgcttgttatcaatggtttagagcaagccatgaatgccatgcctgagggtgaggataaaacgaaacttcaaactcaattggaggaaaacaagaaacagcttgaaaaagctaaagaagagctagggaaagcaaaaactgctttaaccgaggctcagacagaattaacaaaagccaatgacgcttacgagaaaaactacgagggctatgaaaaagttgctgacttagtgaaacctgatagccaagcggatttaaccaacgtagccaccattgctgacgtgcaagcggtagcgaaatcgggcttgaagtttaagggcaatgatggtgttgaagtgcgtaaacaactcagcgaaaccttagcaattaaaggtgaagaaaatgcaagtgacgagaagtttaacagcaacctcaccgccgccggcaatatcaaagtggaaatggcacaagatggcaaaggcttagaagttaaattgtctgaccagttgaaaaacatgacttcgtttgaaactcgtgaagtggacggtaagaaatcccacttggacagcaacggtttacaagcgagcagtctagacagcgaaacttttgtaaatgcacagggtacccatattacgggcaaaggaaatcatgccggtcaatcagcaagttataccctcgatggcgtggcgatcacaggtaagaacgaaagcgtgcagttgaatacgaccgctctttcctttgcaaccactcgagaccaagctggtaaacctgtcggtacaggggttatccgaggtctgaaagacttggatgcccatgctaccggtgatatggcggcaaataaaaactatgtggacgaaaaagtgggtgctgccgttaatcgcctagataatgtcatcagtaccaacaaccgaaccttacaggcgggtattgccggtgcgaatgcggcggcagcattgcctacagtaacgatgccgggtaaatcgaccattgcgttgtccgcagggacttacaaaggcagaaatgcggtagcgataggctattcacgtctaagcgataatggtaagataacgctgaaattacagggcaacagcaactctgccggtgatttcggcggtggcgtgggtgttggttggacatggtagtctagtttaaccgctataaaaaagcagtgagtaatcactgctttttttatgataaaagtttcaccgctctttttagtttttgacgttcgacaaaatcgaaaagaaaatcctgttaaattaattacccttgataatgtccgacgcccagctcgtcttctttacgagtgcggttaataacgacttgcggagattgaacaatacgtaaccccatttcatcttcggtacgaactacctcacctcgcagagaattggtatagacatcagtaattttaatatctacgaacttaccgatcatgttaggcgttcctgcaaaattaactatacgatttgtttccgtacgacctgttaattccataatatcttttttcgatggaccttcaaccaatacacgttgctctgtccctaacattgctcgactaaattgtgctgcttgattgttaatgcgttgttgtagcaaatataggcgttgttttttctcttcttccgttacatcatcaggcatatctgctgccggcgttccgggacgagcagaataaataaagctaaagctcatatcaaaattcacttgagcaattaaattcatcgtgtcttcaaaatcctgatccgtttcccccggaaacccaacaataaaatctgaactaatctgaatattcggccgcacttttttcaatttgcgaataattgatttatattcaagtgcggtatgatttcgcttcattaaattcagtacacgatctgaaccgctttgcacaggtaaatgtaagaaactcaccaattcaggcgtatccgcatatacatcaataatatcatcagtaaattcaattgggtggctggtggtaaaacgtaatcgatcaattccatcaatagaagcgactaaacgtaataactcagcaaatgaacaaataccgccatcatgtgttggtccacgataagcgttcacattctgccccaataaattgacttcacgcaccccttgctctgcaagttgtgcaatttcgaataagacatcatctacgggacgacttacctcttcacctcgagtataaggcactacacagaatgaacaatatttattacagccctccatgatagaaacgaacgctgtcggtccttccgctctcggttccggtaggcgatcaaatttctcaatttcaggaaaacttacatcaaccaccgcactttttccaccacgaatttgattaatcatttcaggtaggcgatgcaatgtttgtggtccaaatacaatatcaacataaggtgcacgtgaacgaatatgctccccttcctgtgaagccacacaaccgcccacaccaattaccaagctcggattttgtttctttaattctttccaacgacctaactgatgaaacactttttcttgtgctttttcacgaatagaacaggtatttaatagcaatacgtctgcttcttccggtacatcagtcagttctaaaccatgggtatttaaaagcaaatctgccattttcgaactatcatattcgttcatttggcagccccaagttttaatatgtaatttttgtgtcatgtcagtttttaaaattaatatctaagtaaaaaatcagtcggtcattttaccgagttgttgtagctgttgccagctaaaaatcagattttattttttaaatttaaccaataacgctaaaatagcgaaaattagtctgtggagaaaacacgtatgcaaaaagatattattgttgttggtggcggtatgattggtgcggcttgtgcgacaggattagctcaattgggattacaaattcacgtcattgaacatcattctctacctgaatttgattcgacatcggagtatgacattcgcatttctgcaattagtgctgcatcagttaatttattgaaaaccctaaaggcatggcagcatatcgaaaaaatgcgtattttcccttatcgaggactggaaacttgggaaattgaaggttttgcaacccaatttcactgccaagatttacagttagcggaacttggatttatggtagaaaataatcttattcaactaggattatggcagacattttcttcctaccataatattactaccaacgtggaaaatgcgattaaaaatgttgaaaagtgcggtaaaaattggcgtatttttttatccaatggagaaagttatcaagcacctctcatcattgcagctgacggtgccaattcacaattacgccaaattgcaggcataggtttgacaggctggcaatatcgacaagattgcatgctcattttagtgaatgtagaacaagatcaacaacatattacttggcaacaattttatccctccggacctagagccttgttaccattacaaaataagcaagcctgtttagtttggtatgacagcccacaaaaaatacgtgaattaaaacagctgtcaaatgaaaaacttgcagaagaaattcatcaagcatttccccctagactgggcaaaataaacgtacaaaaatttgcgacttttgcactaacacgtcgtcatgcacaagattatttcaaacaaggtattgttttagttggcgatgccgctcacacgattaatcctcttgccggacaaggtgtcaatttaggttttaaagacgtcaaagtcctgcttagtgtaattgaaagtgcggtaaaaaataatgaagatttttcaacggatcatgttttacaacgttatcaaaaccgacggaagcctgataatttactgatgcaatctagcatggatttgttttataaagcctttaaagaagatagcatgccattaaaaatagctcgtaacttggcattactgggtgcaaacaaaatcacgcctcttaaaaaacaagcgttgaaatacgcacttggtttgtaaaaaatcacctaaaaatgaaatcatcactttcaattatgagctaatcgctatatcattagccattcaaaactaagggcgcttgcaattttattgtgggctttttatttctactcaatacctgaacaaacgcaggttcattagggagaaaaccaaagctagtggaaaatacagttcaaaacaagcctattattgagcttcgttctcttactaagtcttatgatacaaaaaccattatcaataacttcaatttaactattaataacggtgaatttttaacaattctaggtccgtcaggttgcggtaaaacaacagtgttacgtttgattgccggctttgaagagttaaatgaaggtcgtattattcttgatggtgaagatgtgacggatataccggcagagcgtcgtcacataaacaccgtattccaaagttatgccctgttcccacatatgacgatttttgaaaatgtggcctttggtttacgcatgcaaaaagtaccgaatgcagacattaaacctcgtgtaatggaagcattacgcatggtgcgtctagaagaaatggcggatcgtaagccaactcagctttccggcggtcaacaacaacgtgtcgccattgcaagagcggtagtaaataaacctaaagttttattgcttgatgaatctttatccgctcttgattataaattacgtaaagaaatgcaaaatgagttgaaagcattgcaacgtcagttgggaattacctttattttcgttactcacgatcaggaagaggcattaactatgtcagatcgtattatcgtaatgaacaaaggcactatccaacaagatggttcaccacgtgatatttacgaggatcctaaaaatctatttgtggcaaaatttatcggtgaaatcaatatttttgatgcgatagttattgagcgtacagacgaaaaaactgttaaagccaatgtagaaggtcgtgtttgcgatattcatacagagttgactgtccaaccaaatcagaaattaaaaatcttgttacgtccagaagatattataattgaagaacttgatgaaaatgaaagttccaaagcaattattggacatgttgttgatcgtagctataaaggcatgacattagagtcaagcatcattcttgatcataataaaatgaaagtattggtgagtgaattctttaatgaagatgatccgcatatcgatcattcagtgggtcaaaaagtggcactaacgtggcatgaaggctgggaggttgtactggacgatgaagatgaacagtaataaatttcaaaacttaactgttagtgtcattttcggctggttactcttctttgttttagtaccaaacctgctagtcttaacagttagttttttatcaaaagatagcagtaatttttatgctttgccttttagcttggaaagttacgcaaacttagttgactcacattacgccaaagtaatgtggaattcactccgtatgtctgcgattgcaactgttatctgtttacttgtaggttatccttttgcatttttcattgccaaaataaaaccctcataccgtccatttttgctattcctcgttgttttacctttttggacgaattcgttaattcgtatttacggaatgaaaatctttcttggtatgaaaggtattttaaacaataccctaattgcaatcggtattattgacacaccaattcgtatcttgaataccgaaactgcggtaatcattggattagtttacatcttactgccttttatgattttaccgctttacgctgccattgaaaaactggatcttcgtttattggaagctgcaaaggatttgggagcaaattcatttcaacgttttattagaatcattattccattaacaatgccgggaattatcgcaggttgtttgttagttctattacccgcaatgggaatgttctatgtgtcagatttgcttggcggtgcgaaagcagccctagtaggtaatgaaatttatgtccaattcttaaaaataagaaactggcctatgggttcagcaattagtatagcacttactctactaatggctttattaatttttatttactataaaacaagtaaattattaaataaaaaaatggagttggaataatgagtcgtttactacgtaatgtctttttgtttgtggtatacgcttatctgtatatcccgattattattctaatcagtaattcatttaacaatgatcgtttcggtaatacttggaaaggtttcggtttccaatggtatgagcgtttattcaacaacgatactctcattcaagccgctattcattccatcactattgcattttttgcagcctcattagcaacaattattgggacattaactgctatcgcactttatcgttatcgcttccgtggtaaacaggctataagcggaatgctgtttattgtgatgatgtcgcctgatattgttatggctgtctccctacttgcattgtttatgatagtaggtatctctttaggattttggtcattacttttagctcacgtaacattctgtttgccttatgttgtagtcagtgttttctctcgtctaaaaggttttgataacaaaatgttggaagcggcaaaagatttaggtgccggtgaagtaacaatactacgcaagatcattttaccgttagcgttgcctgccattgtttcaggttggctacttagctttaccatttcattagatgatgtagttgtgtcctcatttgtcagtggtgtaagttatgaaattttaccattaaagattttctccttagtgaaaaccggggtaacccctgaagtcaatgcactggcaacactaatgattattttctctttaatcttggtaatactcagtcaacttgttgccaaaaaagggaaataataatattccaaaactgtgaaataatatttcacaaatgatcctatatcacataaaataacacgccctactttcggtaaggcgtttttattccttcaacaccgaagtatattccgcatgttaaaagtgcggtcgttttttactcttatattggagaacaatagaaatgaaaaaattttcaggtcttttcacactgggaatgatcgctgtagctctagcggcttgtaatgataaagatactcaaaaagcagagactcaagcacctgctgcttctacaggtgatactgtttatctttatacttggacagaatatgttcctgatggattattagaaggcttcactcaagaaacaggcattaaagtcaaccgttcaagtctagaatctaacgaaacaatgtatgcaaaaattaaaactcaaggtgctgccggcggttatgatgttattgctccgtcaaactactttgtttcaaaaatggctcgtgaaggtatgctaatggaattagaccacagcaaattacctgtcatcaaagaattaaaccctgattggttagacaaaccttacgataaaggtaacaaatactctttacctcaattgttaggagcaccgggcattgcatttaatacaaatgaatataaaggctctgacttcacatcgtgggctgatttatggaaacctgaatttgccggtaaagttcaattattggatgacgcacgagaagtattcaatatcgcattgttaaaattaggacaggatccaaatacacaagatcctaaaattatcgaacaagcgtatgaagagttattaaaattacgtccaaacgtactatctttcaactcagataacccggctaattcttttatttcaggggaagtgagtattggtcaattatggaacggttctgtacgtatcgctaaaaaagaaaaagcacctttagatatggtattcccgaaagaggggcctgttctttgggttgatacattagccattccatcaacatctaaaaatccggatgctgcacataagttaattaactacatgttaggtgcaaaaacagcagcacaactcaccttggaaattggttatccaacctctaatatcaaggcgttagaattacttccggctgaaattactcaagatccggcaatctaccctacagctgaagttttacaaaacagttactggcaagatgatgtcggtgatgcagttcagtattacgaagaattctatcaaaaattaaaagcggcaaaataatctttgcacacaaaagaaatgctcccattggagcatttctgttttgaaaataagcttaagctaaattcccaactaaatttttcacaaattccaaccgctctttatgtgacgtcaatgacttactaaacctaaacttagtcggtccgtcaaatttaaatacagtaggctgagactgaattaattgcacaaatttcatcggatcaagttctgcattttcagaaaactcaataaatcccccattaattgtgctatcaattttgacaatttttaaggtttttgccagcaaacgtaactcagcaatttgcattaaattcttacctgcctccggtaataagccaaaacgatcaatcaactctactttcaattcatctaactctgcctgattttccgctccggcaatccgtttataaaaagataatctcatattcacatcaccaagatattcttccggtaataatgcgggtgcacgtaaatcaatctctacttgctgttgtgttaaagtatccaaagaaggttctcgcccttcttttaatgcagcgacagcattttccaataattccatataaagcgaaaaaccgatactttcaatttgaccgctttgctcatttccgagcaattcaccggctcccctaatttctaaatcatgggtagccaaaataaatccggcacctaaattatctagactttccagtgcctctaaacgcttaacggcatctttggtcattgcttttggatgaggtgtcaacaaataagcatatgcctgatgatgagaacgtccaactcttcctctcagctgatgtaattgggctaatccaaaattatccgcccgttcaataataatcgtgttagccgttgggacatcaatccctgtttcaataatagtagagcaaaccagtacattaaaacgctgatgataaaaatcggacattacacgctccaactctctttctcgcatttgcccatgcccaacaaccactctcgcttccggtacaagtgcggtcagtttttctgcacaattttcaatacttgccacatcattatgtaaataataaacctgtcctccccgtaaaatttcacgcaacacagcttctcgaataatcaaatcgtctacctgtcttacaaaggtctttatgctcaatcgtcgtgccggcggtgtggaaataattgataaatcacggatgccactcatcgccatatttaatgttcgaggaataggtgttgccgttagggttaaaatatcaatattggttcgtagctgtttgattttctctttttggctcactccgaaacgatgttcttcatcaataatgagcaaaccgagatcgctgaattttacttctgactgaattaatttatgcgtaccgattaaaatatcaattttaccttcattcaagtgttgtaaaatttgtttctgctcttttgccgttctaaaacgtgacaacatttcgacattaaccggcagattggcaaatcgatctttaaaattttcataatgttgctgtgccaataaagtcgtaggaaccaaaaccgctacttgtttatggttcatcacggctaaaaatgccgctctcattgccacttccgttttaccaaaccccacatcaccacaaactaaacgatccatagcttttttttggcacatatcagaaataaccgcattaattgccattttttgatcgggtgtttcttcaaaaggaaacgtggcagcaaattgtttaaattcttctttatcatattgaaatgcaaagccttttttaacttcacgttgagcataaacatccagcagttcagcagcaacatcacgaattttttctatcgccttatgtcgggcctttgcccaactatcattaccaagtttatgtaaaggtgcattttcatcagatccgccaacatagcgactaattaaatgcaaagaggtaacgggtacataaagttttgaattattcgcatattccaataataaaaactcagctttaattccaccattttctaaactcaccaatccaccatagcgtccaacaccatgctctaaatgcacaacaggttgtcctatttttaattcagcaagattgcgaatgagtgtatcgggattggcaactctacgtttattacgctcacgttgttgcactcgctctcccaataattcagtttcacaaataatggcaaccttatcctcattatcaataataaatccatgttctaaactactgatgagcaggcttttagctggcttatctttttcacccaaatcctgaatttgcgttggtttgagctttaaaggtaagagtaaatccaataatgtttcccgacgcccttctgtttctactgaaaaaataacagttccgtcaaattcctcaataaactgacgcaatttttgcaaaggttctttttgttgtacttgaacggttaattccggcaacggctgcacaggtaaatttttttgacgaacagaagtgcggtccaattttttactttttaaactcaatcttggataattttttaactgccgattaacttcatcaatgcgtaaccacaatttttccggcatcagcaacggacgcatcggatcaacacgacggctttcataacgttgttcaatatcctgataaaaacgttctgcttgcggcacaatttgttcaaaatccacaaacaatgtattttcaggtatgtaatcaaacaacgtcgccatttgattaaaaaagagcggttgccaatattcgattccggaaactagagttcctttactgatttgttgataaatatgttcaggatctcgtctaatttccgcaaaagtttctctaaattgactacgaaaaaattcaatgccttttctatctgttgggaactcttgtgcaggtaataaattaatacgttgaatttcctctaatgtacgttgcgtatctacatcaaaagtacgaatactatcaatttcatcatcaaaaaaatccaatcgaaaaggcaccgcacttcccatcggaaataaatccaataaagcacctcgtactgcaaattcgccatgttccagtacttgttcgactgctcgataaccggcattttccagctgtaaacgaaatctttcgatatttaatcgatcacctcgttttatcaataatacattgtgttgtaaaaattctgccggacaaactcgttgcattacagtcgtaattggtgcaataaagatacctttgttgctatgttgcaactgaaacaaggcacttaagcgagctgaaataatttcttgatgcggcgaaaaattatcgtagggtaaagtttcccaatcaggaaaaaatgtaacaggttgttgagtgaattcagttaaaattttttctaaacagaccgcacttttaacatcaggggtcatcacaaaaatcaacccatcatatcgccgtacaatttctgcaatcacaagactatcagccccctgtaatacattacctagaagtttatgctcattgggctgggtaggtatgtcaaaattaaaatacatcatattcaaatggatttatgttgaaaagttgccatgtaatttgcactgacatcttgatttaaccaaaattttccggttaaaagattgtaatgataaccacaaatatttttacagactaaatttgcttggtcagtccaatgcagtaactcagccggtttgataaatttatcgtaatcatgtgttcctttcggtaacattttaagtatatattctgcacctaagaccactaatgcccatgctttaaatgtgcgattaatagtcgaaaaaaataagacaccattcggttttaataaagctcggcaagactgaatgatggataaggggtcaggaacatgctccagcatttccatacaagtaatcacatcaaatttttcagcgtaaagtgcggtttgtttttgtaaaaattcttcaacggtaatttgctgataatctatgaccagtccttgttccttggcgtgtaaacgagcgacttcaagaggagcaacggtcatatcaattcctgttactattgccccttgctttgccatagcctcagacaaaataccgccaccacaccccacatcaagcacttttttttccgttagtccgttagcttgctgttggatatattgtaatcgtgtcggattaagttgatgaataggtttaaaatctccattcggatcccaccaactttttgccattttttcaaatttttctaattcttgcggatcaagattttgcatttttatcagtccgtatagcagtaaaaaataattacgctattattccttaactgcgttaaaaattcactacaaaatttcgagaaaatcagaagttatgctataatctcgccaatttttcgtacctaattaggaaatctcaatgactgattttacccccaacgttactcctgtgagtatagaagaagagcttaaatcttcgtatcttgattatgcgatgtctgtaattgtcgggcgagctttgcctgatgtacgtgacggtttaaaaccggtgcatcggcgtgtgcttttttctatggatcaaagtagcaatacttacaataaagcctacgtaaaatctgctcgtgttgtaggggacgttatcggtaaatatcatcctcacggtgatagtgcggtgtacgatactattgttcgtatggcacaacctttctcgttacgctatatgttggttgatggtcaaggtaacttcggttcggtagatggtgatgcaccggctgcaatgcgttacaccgaagtacgtatgcaaaaaatcacccaagaattactcaccgacttagataaagaaacagtggatttttcgccaaactatgatggaaaagaaatgatccctgatgtcttgccaaccaaaattccaacattattggtcaatggttcttctggtatcgctgtgggtatggcaaccaatattccgccacataatttaaatgaagtattggatggctgtttagcctatgtggataacgaagaaatcagtattgatgaactaatgcagtatattcctggtcctgacttccctactgccgctttaatcaatggacgtaaaggaattgaagaagcatacaaaacaggacgaggaaaaatctatgttcgtgcaaaagcggaaattgaaactaacgataaaggtcgagaaaccattgttgttactgaaattccgtatcaagtcaataaagcaaaattagtagaaaaaattgcggaactcgtgcgtgaaaagaaaattgaaggcatcagtaatgtacgagatgtgtcaaataaagagggtaaccgtgttgaagtagaagttaaacgtgatgcagtcggtgaagtcgtacttaataatctgtatgccttaacccaaatgcaagtgacgtttgggatcaatatggttgccttggatcatggtcaaccaaagctattaaatttaaaacaaattattgaagcatttgttcgccatcgccgtgaagttattactcgtcgcactgtatttgaacttcgaaaagctcgtgagcgtgcacatattttggaaggcttggcaattgccttagcgaatattgatcctgttattgaattaattcgtgcctctaaaaccgctgatgaagctcgtgtcggtttattatctcaagcttgggaattaggtaatgtagcaacaatgctcagtgcaacaggcgtagatagttctcgtccggataatttggctgataacttaggcatcatcgacggtaaatactatctttccgatgaacaagctcgtgcaatcttagatttacgtttacaacgcttaacggggcttgaacacgaaaaaattgttactgaatatcaagaaatattaattgaaattggcaaacttttacatattctaaacagtgcggatcgtttgaaagaagtcttgtgtgaagaactggaaaaagtaaaagaagaatttggtgatgcacgtcgcactgaaattacatcggcatccggcgatattaatttagaagatcttattacccaagaagatgtcattgttacactttctcatgcaggttatgtaaaatatcaaccgcttacagactatgaggcacaacgccgtggcggtaaaggtaaatctgcaactaaaatgaaagatgaagattttattgagcgtttattagttgccaatactcatgacactattctttgcttttcaagtcgaggcagattatattggttaaaagtatatcaactaccgcaagcaaatcgaggggctcgtggtcgtcctattgttaatattctcccattacaagaaaatgaacgtattacggcaattctaccagtggctgcctatgaagaggataaatttatcgtcatggcaactgccggagggcttgtgaaaaaaattgcgttaaccgaatttagtcgccctcgttcaagcggtattatcgcacttaatttacgtgatgaagatgaattaatcggcgttgatattacagatggtaccaatgaaatcatgctcttctcatcacaaggtcgagtagttcgttttgaggaaaatgcagttcgagcaatgggacgtttagcgacaggggtacgaggtattaaactggcattaacaaatgatatttccgatgatgaaagtgcggtagaaattgaggatatttctgatgaggatacaaaagaacctcttgatctcaatgtagataaagtggtgtcattggttattccaaaaaatgacggtgcaattctaaccgctacacaaaatggttatggaaaacgtaccgcactttccgagtatccaaccaaatctcgtaatactaaaggggtcatctcaattaaagtcagtgacagaaatggtaaagtagtcgctgcaacgcaagtagaggaaaatgatcaaattatgctgattaccgatgctggtacattggttcgtacgagagtgagtgaaatcagcattgtcggacgcaatactcaaggtgttcgactcattcgaacagcggaaacagaacaagtcgttagcttagaacgagtttgtgatactgatgaagatgaagaaaatatcgataacaattttgaatagagaacagactaaatcatcataatttcaagggcgattatcgccctttctttatgtccaaaaaatatgactctctaccttatttatacccacttaatatgtgcttttttagcttggcattactgattattcgagggctgatacaaatggataataaatcagcaaaaatactcaatccgctattttttcctgatttactctgtctaagtgcggtcgttttttctcggattttttcataattgaaaaatcaataaaatatgtcattatttaatccctcatttctctacaaaaaagctattttccctttttggtaaagcgaatttttttgctatactcgagcactgcttttattaggagaaacaatatggaacaaatgccgaattgcccaaaatgtcagggtgaatacgtatatcacgacacaattaattttgtttgtcctgactgtggaaatgaatggactgacaatgaaattgaacaacaaaacgaagatcaactcatcgtaaaagatagcaatggaaatatattaactaatggcgatgatgtgcttttaattaaggatttaaaattaaaaggatcttcagaagtactaaaaaaaggcacaaagtacaaaaatattcgtttagtaacaggtgatcataatgttgactgcggcaaattattactaaaatctgaatttttaaagaaagcttaaattataactatcatgtttatctaaattggagttgttatgaaaaataaaattctcggcagtgcattaatgatcgccggcacaactataggtgcgggcatgttggctatgccattgacctcagccggcatggggttttccatgacgttagtgctacttgcaggattatggttattattgacctataccggcttgttgtttatggaagtttatcaaactgcaaaagaaaaagatgtaggcgttgcaactcttgcagaacagtatttcggtttaaccggacgttttttggcgactattagcttgctcgttctactctatgccttacttgccgcttatattaccggtggcggctctcttttatcaggccttttaacgggtattggtgatgaaaaacaaacttctcaaatctcaatattactctttaccctaattttaggtgcatttgttgtgattggtattaaaggggttgacggcttaacccgactcttgtttatcggaaaaatcattggctttattgcggtcttattaatgatgttaccaaaggcaaaattagaaaacctaggggcaattcctttagataatctattggttatttctgcaattccaattttctttacctcttttggcttccacgtcattatggggagtatcaatagctaccttgatgcagatattcgtaaaatccgtttagccattattattggaacgttaattccattatttgcctatttattatggcaattcgcaacacatggcgtattaagccaaactcaatttgttagcctattaaaacaagatccgaccctaaatggattagtaaaagcgactagtcaaattactggaagtagcctattaggtgaggtagttcgcctattctcatctcttgcattaattacttctttcttaggcgttgcaatgggaatttttgaaggagttggtgatctattaaaacgtattaatctgccgacaaatcgcccgatactggcacttttaacttttattccgccactagcctttgctctattctatccaaacggttttatcaccgcactaggttatgccggcattttatttgccttctatgggctacttcttcctgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataaattaaaaagagcggttaaatttttataaattcaaccgctctttctattaaattttaaaaataatgcctcacaattcatattatgaagtgttacgtttatctaaaagcaatttagtctactattttttcggtaaaacgttcaattttcgcacccaatccacgtaattttttttcaatatgctcataaccacgatcaatgtgataaatgcgatcaacgatggtttcacctgtggcaatacaaccggctaagacaagactgatagaagcacgtaaatccgttgccataacttctgctccggataaatattcaacaccatgacaaaatgctgtgttaccttcaatctcagcctttcctcccatacgaattaattcaggaatatgcataaaacgattttcaaaaatagtctcggtaattttacttgaaccctctgcaaccatatttaataaagtaaattgagcttgcatatcagttggaaaaccgggataaggttcagtacgtatatttaccgcttttggtctattaccttgcatatccaatgtaatcgtattttccgtgacttcaattttagcaccggcatcacgcaatttatcaattactgcatctaaagttgatgctttagtatttttacaaatgatacgtccgccggaaatagcggctgcaactaaaaaagtaccggtttcaatacgatccggcacaatactatgctcacaacctcctaggcgttcaacaccttctatcgtgataatatctgaacccgcaccgctaatttttgctcccatcttatttaaaaatacagcagtatcagtgatctcaggttcacgagctgcattttcaattactgttatgcctttcgctagagttgcagctatcataatagataaagtcgcaccaacacttactttctcaataacaattcgtttaccgattaattgaccatcaacaaaagccttaacataaccgtcttccaatacaatttttgctccaagtcgctccagcccgctgatatgtaaatcaacaggtcttgcaccaatagaacaacctcccggtaatgaaacttgcccttgtttaaaacgagatactaaaggcgctaatgcccaaatagacgcacgcatcgtcttaaccaactcataaggagctacaaaatgattaatatttgaagcgtctaaatgcaccgcaccttgttcatctcgataagttaccacacctaattgttgcagaatttttaacgtggtatcaatatcttttaactcaggtacattagttaatttgacaggctcttcagctagaatggccgcaaacaaaataggtaaggcggcatttttagcaccggaaatattcacttctccatttaaacgagactgcccataaacatgaaatttttgcatatgttacttcctacttatgctacatattcaataaacgatcacgcttccactgttcagtactgaatgtttttattgttaacgcatgaatcgcaccggatttaaaatgtgccattaaaggtgcataaatagtttgctgttgttttagtctggacagttgtgcaatttcatcgtttacaacaatgacaccaaaatgtgcattttcaccctgaacatatacttcatcgagattcaatgcttcctttaaaatttgctcaatttgctgagtttccattaatattttccactattgtaaaaaaggcttaagccaatcagataagccaaaaagatctgccaaaatttccaattgaattggggcattatgaattttttgtgaacttacttgtttttcaagctcattaataaaatcacctagcaaagcaaaaccagcactatcaatgcgattaacttcactgagctcccaaacaagttgctgaccaacaagctccgcacttgataaaagttcatcacgttgttgcaaaaaaggaagcaatgtatctcgtgataacgctcccataattcggagcgtcatcttatcactatttttttctaatgcccaattcagattgttctctttcatacgttatttactactaataataattggttgtttagaaaattcttccatctcatcaatcaaagtttctataccttttttgcgtaaaataggtaaccattcctgtcttgttgagtgaaccgtactcacaccgttagcggacatatcatacacttgccacttacctgatttactgttcttacgccaataaaactctaaatcaataggtgcaacattgccgctttgcagtattttaaccggcacattcatttgatctgccgttacattaatcggctttaatacactaattttctgattactataaagcgttaatgctttggcatattgatattcgataaatttatcaaataccgcaaagaattttgcacgttgttccggtgatgttgatttaaaataaggccctaacactaaagatcctgcataatttacatgagcatagggcatgagtccttgacgtacgatagtacgcaaataattaggatcttgtttaatcttactttggttagtatcaatggctttaaataaacgctcagatacatcaagcgttagttcataaggtgtttcttccgccatagcttgtacagcaaaaagtgcggtcattgccacaattattttaaaaaatagtttttttaacataaatattagctcctaaatctacagtgtataaaaaattattgaacatccgattccaattgcttttgagtgcttttattttctttgctgccatataagaattgcccgacaagatcctccaataccatagctgatttagtatctacaatacgacttccctcttttaacatggaagtttcaccatcatcaaatccaacgctaagggaaatatactgctcacctaacaaacctgaggttttaattgataatgaactgttatctggaatttcattgtacttttcatctatagcaattttaaccagcggtaaataggttttatcatcaagttcaattgatgatactctgcctattacaacaccaccgactttcaaaggagctctaactttaagtccgccaatattatcaaaaacagcataaacttgataagattttgcttgattaaacccttgtatattcgcaactcttaatccaagaaaaaccaatgccccaataccaattaataaaaataatcccacccaaaattcatgtttaactgtttgtctcataaaaaatccttaattttctaccgcactttatttatgaacctgcaccaaacatcaacgctgttagtacaaaatccaatcctaaaacaacaagagaagcatgcaccaccgttttcgttgtcgctttactaattccctctgatgtcgggatacaatcatagccgttgaataatgcaatccaaacaacagcgatggcaaaacataaactcttaatacaaccgtttaataaatcatatccccagctaacggagttttgcatcacagaccaaaaactccctgcatccacacctttccaatccacaccgactaaagaaccgccccaaataccgattgcggtaaaaataacggcaagaatgggcatagaaatcacacctgcccaaaaacgaggtgaaataactcgacgcaaaggatcaactgccatcatttctaagctggataactgctctgttgctttcattaaacctatttcagccgtaagagctgagccggctcgaccagcgaataaaagtgcggttacaacagggcctaattctcgtaacaatgataatgcaactaattgtccaagacttgtttctgcggaaaaatccactaacaccacatacccttgcaaccccaacaccatgccaataaataaacccgataacatgatgattaacaaagattgtacacctaatacataaagttgtttaataagtaaggggaaatgcttcctcatctgttgtttcccaaccaatgcaccaaaaagcataaaaccggctcgccctaaagaacgacaaaaatccattccccatctacctaaagatgaaataactcggatcatgaaaacaactcctgtacatagtcttgtgcaggaaaatgaaaatgaacaggtccatcttccttaccttgaataaattgcacaacttgcggatctcggctttgtaaaagttgctccgcacttccttcagcgatcactcttttatctgcaataatatacgcataatccgcaatacttaatacttcctgcacatcatgagaaaccacaattgaagttaatcgcaacgcttcatttaaacgtttaattaagctaataatcactcccatactaatgggatcttgccctgcaaaaggctcatcgtacatgattaactccggatcaagtgcaatggtgcgagctaatgcggctcgtcttgccataccgcctgacaattccgacggcattaaatttgccgcaccacgcaaccccacagcttccaatttcatcaacacaatttgacgaataagtttttccggtaaatgtgtatgctctcgaataggaaaagcgacattatcaaaagttgataaatcggtaaataatgcgccagactgaaataacattcctatgcgttgacgaactcgatataactcactattggacattttacaaatatcttgctcatcaaacaaaatttcgcctttttcaggttgaagttgtcctccaatcagttttagcaacgtggttttaccaatgcctgacggtcccataattgcagtaattttgccttgctgtacctgcaaattgagattgtcataaataattcgattacctcgcttaaaagttaggtttctgacttctattaaaggtcttgtcatagtttcttcattactctacttatatttgtacaaaatgagatcggatattccacgaatttccggtcattgtcaaattaaattatgatgattttcaaccgcacaatccaaacgagatgtctaagttaacaccccagactttaatagattattacatgcttttttaaaaactatgctatgattacgcaatttttgtcaaacacaaaacaatataaggattttatgcatattcgctggaatattattttatcggtgatagctcttgttttactcgcttggttttatactttacagccaaatgataatgaactcagtcagcttataaagtcaagtacacagccggaatacataggagaaaagatgtcaacctctgttttttcgccaacaggaaaaaaacaatatttagcgacagcagataaaattgaacactacaatgaggatagacgcacagaatttcaccaaccactggtctatttatttgatattgatgatgaaaaattcggtaagcaaagttggaaattaagtgctaaaaaagctaaattaacaaaaaataatatgctttatcttgatggtaacgttattgcagaaactttattggataatgctaaattacaacgagttatgactgaaagtgcggtagtaaatttaactactcaagacatcacctctgacacgatggttactataaaaggtcaaaatttcagctccaccggcttaaaactgaccggaaatttacaacaacaaattgcaaccttaaaagaacaggtaaaaacccattatgaaatcaacaacaaataagtatttattaattaccgcacttatgatgacttcaatatcagctttagccctaaaagatgatacaaatcaaccgatagatatcgtatctgaccatcaatcccttgatatggaaaactctgtggtaacttttacaaataacgtagtcattaaacaagggtcaattttaattaaagcgaataaagtcgttattactcgcccaacagaaaaatccaataaaaaagaaactgttgaggctttcggtaatccggttctctttaatcaattacttgataatggaaaacctgttcagggcaaggcgaataaaatccactatgatctcagtgccgaatttttaactttaatgggtaatgcggaattaaagcaactggatagcaaaattaacggtgaaaagatcacctatgatgtcaagaaacaacaactcaaagcaaatggagccggaacatccagagtaaaaacagtattaattccgactcaattcaataatcaacacaagaaataaccgggtaaattagtatgtctatactgcatgcagaacatctcgctaaaagctataaaaaccgtcaagtggtttctgatgtaagtttaacagtgaactctaatgaaattgtaggtttactgggaccgaatggtgcgggaaaaaccacaacattttatatgatcgtcggtttaatacgccatgatcaaggaaaaattcacattgataacgaagatatcagtttgttgcctatgcacaaacgagcacagcgaggaatgggttatctgccacaagaagcctctattttccgacgattgagtgtttatgaaaatttaatggcagtcttggaaattcgtaaagatttaaatatgcaacaacgccgtactcgagctgatgagctgattgaagaatttaatatcggtcatatctgtgataatttgggacaatctttatcgggcggtgaacgtcgtcgtgtagaaattgcacgtgccttagctgcaaaccctaaatttattttattggatgaaccttttgccggtgttgatcccatttccgtaattgatataaagaaaattatccaagatttacgcaatcgtggattgggtgtgttaatcactgatcataatgtgcgagaaacactggacgtttgtgaacgagcttacattgtcagctcaggaaaaatgatagcaacgggtacgcctgctgaagtcatgaataacgaacaagttaaacaagtttatcttggtaaagaatttaaattgtaattatgcttaaatttactgaattactctctcctgaaaatatccgtcaagggttaacttgtacaagcaaaaaaagagcttttgaaatcatatccagcttaattgctaaacaactttcagaacaaattgatggcttagaagcagatgaagttagtcttcaggaaaaagaaactctttgtaccgattctttactcaaccgagaaaaattaggcaactccagtttgggaaacggtatggctatgcctaaaggaagattacccctaggtaatacacctatcgcagttttcttacaactgagtgcacctttaaaatatgatgcacttgatcatcgtgaagtcgatcttatttttgccttattatccccgacagaacattgttccaatctcgttcaagaattgccccatttagtagagcgtttaaaagacaaatctctaattaaacaattaagaaacgcacaaagtgcggaggaaatttggcaaatttttcaattttcagatagacaggcggaaacattaccaactactgaacaacaccatactgaaacaaaatatcccgaggaagaataaaaatggagattatcattattagtggacgctcaggtgcaggaaagtccgtagcattgcgagcattggaagatattggctattattgtgttgataatctcacgatggatttagttcctcaacttgttgatatgttggaaaacaaacagcatttagtagcaatcagtttagatattcgtaacttacctcaagaacctgaaacattggatcacatcttaaatttgctgcaagaaaaatatccggtaaaaattattttcttggatacggatagaaataccttaattcgccgttatagcgactctcgtcgtttacatccgttatcggtccaaaatctgtctcttgaagcggcaattgctgcagaaaaagagcatcttgaacctttagtacaacatgccaatgtaattattgataccacaccgctttctccccatgaacttgctgaacgtttacgtgaatttttgcgtggcaatacggaaaaagaattacaaattattgtcgaatcttttggatttaaatatggtattcctttagatgctgattatgtttttgatgtacgttttttaccaaatccacattggaatcaggaattacgcccaatgacaggattagaaaaaccagttatcgaatttatgcaaaaacatattgaagttgacaactttatttatcagacacgtaactatattgaaaactggttgccaatgttagaaaaaaataaccgcagttatttaaccattgcaattggttgtacaggcggtaaacatcgttctgtttatatcgctcaacaaattggtgaatatttccgagcgaagggaaagaaagtgcaaatccaacataaatcattggaaaaacatacacaaaataaataaccccaaacttaaattcggggttattttgtcagtaattatttaactcgttgtcccgcttttgcacctgcatcaacatcaagtaaatataaatccgcaccaccgttgcctgcgcttaaaatcataccttcagacattccaaacttcatttttcttggtgctaagtttgcgaccataatcacaaaacgcccctccaaatcttccggcttaccatacgccgctttaattccggaaaatacttgacgagtttcattgcctatatccagtataaatttcagcaacttattactttctggcacggcttcacatttcaaaactttcgctacccgtaaatccactttgcaaaaatcatcgatagtaatgctttcttcaattggctcaaactcggaaaatgctttattttctaccgcacttttccctgcggtttggttagctttcgcattttctatttttgaagcctcgatcatttcttcaatttttttcatatctaagcgtgaaaatagaggtttaaacggtgcaatttgatgatctaacaaagggcttgctacattttcccaagtcaattgcgtatttaaaaatgcttctgcacgtgctgctagatttggtaggacaggtttcaagtaacctattaatacacggaataattcaatccccattgaacacacttgttgtagttcatctgtgcgactttcgtctttggcaataacccaaggtgctttttcatcaacatatttattggctttatcagtaagtgccataatttcacgaatcgcttttccaaactcacgattttcatagtagtcggcaattaactctgactgtgcaataaattcatcgaacaacattttatcatctaatttattcgccaatttcccgtcaaaacgtttttgaataaaacttgcatttcttgaagctagattaactaatttattcaccaaatccgtatttacacgctgtacaaaatcgtccaaatttaaatccaaatcatcgatacggctgcctaatttagcagcatagtaataacgtaagcattcaggatctaaatatttcaagtaagtggcggcttgaataaacgtccctcgagattttgacattttctcaccgttgacagtaacgtagccatgtacgaaaatattattcggtttgcgtaaactggctccatccaacatcgccggccaaaataaactgtggaaatacataatgtctttaccaataaaatgataaagctcagcatggctctctttgctccagaaactatcaaaatcaataccgctctttttaccacagagatttttaaacgatgccatataaccaatcggtgcatctaaccatacataaaaatatttattgtcagtattaggaattttaaagccaaaataaggtgcatcacgagaaatatcccattgttgtaatccagcctcaaaccattcctgcattttatttgcgacttcttgttgtaaagaccctgaacgtatccattctgttaacattgccccaaaagcaggtaaatcaaagaaaaaatgttcactttcttttaataccggcgttgcacctgatactgttgaacgtggtgaaataagttctatcgggctataagttgcagaacaaacttcacagttatcgccatattgatcttccgccttacatttcgggcaagttcctttcacaaaacgatcaggcaaaaacatcgctttttcaggatcgaaaagctgagaaatagtacgagttttaataaaaccattttgcgttaatttgtgataaattgcttcaactaactctctattttcatcactgtgagtggaatgataattatcaaaactaatgttaaaaccattaaaatcagccatatgtttttgttgcacatctgcaattaattgctcaggttttacgcccatttgatctgctttaagcatgattggtgtaccatgagcatcatctgcacaaacaaaataaatttcattaccacgcattcgttggaagcgaacccaaatatccgcttgaatatgttctaacatatgacctaaatgaataggtccgtttgcatagggtaaggcacaagtaactaaaatttgacgtgaattcgttgacattaatttaacctttaaatatgaaaattttgttgttcatcttaccttattagtggtattttttccagctctcgatactttacaatcgtagttatgctatgatgaccgtagcaatttaacttgtttctttaggaaaaaagaatatgacaatccatttttcacataacctctctgaatcacaaaaacaacagttacaagaatgtttccgacaatttagtcatactactttacaaaaagatttaattagcttaggtgcggtcaaaaaaatcgaacttggcggcaatatgttacgcatagagttagtgatgccctttgcgtggaacaccggttttgcacaattaaagaccgcacttagcgataaattagaagcaatcacacgagcaacagaaatcaaatggttacttagctatcaaattgccactctaaaacgagcaaataacctgcctgctgtaaaaggtattaaaaatattattgcggtaagttccggcaaaggcggggtaggaaaatcaacaatctccgtcaatcttgcactggcattacaaactcagggagcaaaagtaggtatcttagatgcagatatttacggaccttccataccgcatatgctaggcgttagtcagaaccgccctacttctccggataatcaacatatcgatccaattcaggcacatggcttagctgccagttccatcggttttttaatggagccggacagtgccacaatttggcgtggcccaatggcaagtagtgctttaagccagttattacaagaaacactttgggcaaatcatggtgaattggattatttggtgattgatatgcctcccggaaccggtgatattcaattaacgttatcacaaaaaattcctgttaccggtgctatcgtcgtaactactccacaagatattgcattacttgatgcaatcaaaggaatttcaatgttccaaagtgtacaagttcccgttcttggtattgttgaaaatatgtctgttcatatttgtagtcaatgtggtcatcatgaaacgattttcggaacaggcggggctaaaaaaatggcacaaaaatatcaaattaaactcttggctcaactaccgttacatattcaattacgtgaagatatggataacggtataccaactgtcatttctgctccagaaagcgaaatatcgcaatctttcttacaattagcagaaaaagtagcttctgaactttattggcaaggtgaaattattcccggagaaattttattcaaagaagtaaattaatatccaagaaatttctagcgtcgggtttgtcctctcttgttcgggctatgatagcatttctctctaattcagcaaggacgcttaatagttgagttaatgctatagaaagaggggtattccgtgctgttgtatcgaacattccgtctagtgttttaaagtcgatttttctatcgtgaaattcagttataacacctataacttgtaatgcaccctgacctatctaggctagcaacaacatcccccctctcggatataattcagtaattctagcctttctgcattattttccctagttccctgaattttgcagcctgcttttttaattggtttatttggtcttttaagtcctgcttatgagttgatactccagcaaatccaacaagagctatttttacctctattcaaaagttacataataaaaacaaatatattgattacttctattttgaagctgtttgcgagtaggtatttaaacgagaaaatttcaacgcatcaaattcatcgtgtataacgtattggtaaatcagcaccaaatccccttgaatatggcaatctcgataacctttccattctccaactaatgtgtgatcttgatagctttcaggcaatggcaagcggtttaacaagcagtgcattgctgtaatatatttcgttcctactagcacatttgggtaacgttttgccaaatcagtcaaatctctagcaaattgtttagagtaactgacctttaattgtttaccagacattagttacccgttaagaatgcgttttgtaaactcttcgacagaataattttctccagcttcaataaaaaagctctctgcattaccgctatctaattcgtccatagctgctaaggtttctttatttgggcgaagataattcaaatcaacagggatagagcgagtcttggcaatttgagccaaaaacatattaaatacttgtgatggtgtaagaccatattgttcaatgacctgataggcttcggatttagtttgctcaactgttctaaagctgatagacgcatttgtaagtgccataagttttctccatagtattacattgaaagactattatagtaagaatgaagttaaaaatctacatttttaatgagattagggattttcatttttaattgctattcaaaagttttcaatgtatatttttgaatatagtcaaaaataaaaacggagcgttacgccccgtttaatttatttttcactttcttccaattcgtctgccatcgctgataaaatttctctagaaagcaaaactaaagcacgataaaagggtaaatttgcatgcttttctacttggttaaaaaactgactagcacaaggtaacaaaaaaatttcaaatagttctcgctgggcttgaatggaatttaaattatcttcaatccaagaggcagttaaaaaaaccaacgcaaaatgatccgcactttctaccactgggcatcctcgctcttgtctaaacgaagaaaattcatccggattaattccataatcagagattttcattgaaataagtggcgtatcagtcataaataaacgctgatattctatttccagtgcgtttaaatccattggtatttgcaaactatctaacgcctctttactttgtttatctgtttccaaacaccaaacctgttccaaacctttttgttgtaaccaagaaaatacgtctgtcattataggatctgtcggttgacgataaaataaattaccgaacaatcggcttattaaggaaaaattattcatttgagctacaatcacgcaataccttccttttgtaacgctaaaagagcggtgagatttttcactgttttttctcttacttcttgcaagatatgttgcttagcttgttcatctaaaatgtgaatatcaccgaaaaaactatgatcaatatcagtaactccacaataattaaacagaccatcaactaagcaattttgtaatgattgtgcaaatccacgttcttgatatttctgtaaattattacccatagtaataaattgttgtatttttttaccatgtaaaagcccctctgaaacaccattttccgttttgtaggcaaccccatggcttaaaatacgatctaaatagccttttaagattgcaggaaatcccatccaccacaatggataaataagtgtaataagatcagattgatcgattaattcttgttcataacgaatttctgccggtgtgattttttgttgtgctgcctgtaattcttcccaagataaaattggattgaaatcaagagcatacaaatccctaactcgtgtttcaacccccagtttttgacccgtctttacagtttgctctaatattgcttggttaaaactcgtctgattattaggatgagtaaaaataattaagtgtttcatttctttctcttattttttttgaacgatcaacgtaattccattcacagcttgaacttcaataatatccccttgttgcaaccctttaccttgaatacgccaagtggtatcgccaaaaacacctcgaccaatgccattttcggctatcacttcaaccttacctagacatcccaacatggcgtgatctcgccggtttaaagaagaatttgcctgatctttttcatctttagtatgttgatatttccaccatgcgacactcaacactattgctaagatgccataaataacgcactgtatagtcagagataaatcaataatgatggtgatcattgaaacaataatagcggctaaaccccaccataataaaaaaacgcctggaacaattatctctgcaatcaataataaaaaacctaaaatcagccaatgccaaaatgtccaagcgtcaaaccattccattttacatgtttcctctcaatagaggacgcctaagcgtccattgatattactgtttattgccttttaacaattcagcaatgcctgcaacagaaccaattaaatttccggcttcaagtggcataagtacaatcttactattatttgcactaccaatctcttttaatgcttcagtgtatttttgagcaataaagtaattgattgctttagtatctccacttgaaattgcgtctgacaccatttgtgttgctttcgcctcggcttcagcagcccgttcacgagcttcagcctgtaaaaacgcttcttgacgttcaccttcagcttttaaaattcgagactgtttttcaccctcggcacgtaaaatttcagcttgacgcacaccttcagcctctaaaatatcagcacgtttattacgttcagctttcatttgtgcattcatcgctgcaatcagctcttgcggtggacgaacatcacgaatctcaatacgtgttactttaattccccaaggattcgttgcttcatctacaatagctaataaacggctgttgatattatcacgttgagaaagcatttcgtctaattccatagaacctaataccgtacgaatatttgtcatggttaaattaatgatggcttgttcaaggtgattgacttcataagctgcacaacgagcatcaataacttgcacaaaacaaaccgcatcgatagacacattagcattatctttagaaataacttcttgcgatggaatatctaagacttgctccatcatattaatacgacgaccgacacgatccacgaaaggtacgacaaaattcaatcccggtgttaaagtgcggatataacgcccgaagcgttctattgtccaatgatagccttgaggaacggtttttaaagttgaatataaaataaatacaattaataaaataaaaataatcgtagcaattggtaacccatcaaatagttccatttcatactccttgcaaaataaaacaaacacaatataaaaatactaccagcatatagtagcttattttagtttatttatctaactaaagtgcggtctgaccaagaatataagatacttattttttagttaaattcgtgacaattttagttaattatttctttatttgacttttattaccacttaatccggtctgtttcattggtttgaccacaaccatcactacgtttttataaaaagcagtatacggtataatagtttatccatcataaaaaggtaaataccatgtctagatatgcaaaaattttattgttaaacggtcctaacttaaatatgttaggaaaacgtgagcctacacattatggcaatctctctttagaagatattgaacaacgcatgcaagaattagctcaacaacatcaacttgagctaagttgctttcaagcaaatagtgaagaaaaattaatagataaaattcaccaaagctttcatctaatcgattttattattatcaatcctgcggcttatactcataccagtgttgcattacgtgatgctttgctatcagtatctattccttttgtagaagttcacttatccaatatccatagacgagaaccttttcgtcaccactcttatcttagtgatattgccgaaggtgttatttgcggattaggtgctcaaggttatgaatttgcattacaatatgcctcgaactatctaaagaaaataaaataatttgcataaattttaccgaatttcacagaaatttatcgcaaaaatttattttttcaggtaatctctcgggcgaaataattcattttaaattaaccgcacttttttatcctcaattttgtctaaattggggattttaatggcgatttatttatgaacagtattaattttagttattttaggaaatcattatggacgttcgtaaaattaaaaaacttatcgaattagttgaagaatcaggcattatggagcttgaaatttctgaaggagaagagaccattcgcattaatcgtggctcccctgtttccaatcctattcaatataatgttcctgttacagcacctacaccagtagttgctccgcctacagtgtcggaagcaaccggtacgccagtaacacaagtaaatgaagaaccgtcaggtcatattattcgctcaccaatggtcggtactttctatcgtagcccaagcccagaagccaaagcttttattgaaataggacaacatgtcaaagttggtgatacactttgtattgtcgaggctatgaaaatgatgaataaaattgaagctgataaagcgggaatcatcaaagcaattttagtcaatgatggcgaacctgttgaatttgatgaatctctgattgtaatcgaataattattttacttttataggacttttaccgtcctacaacattattccaagagatagattcttatgttagaaaaagttgttattgccaatcgtggtgaaattgcattacgtattctgcgtgcttgtaaagagcttggtataaaaactgttgcagtacattcaacagccgatcgtgagttaaaacatgttttattggctgatgaaactgtttgtattggtcccgcaccttccgccaaaagctatttgaatattcctgctattattgcggctgctgaagttactggtacagatgcgattcaccccggctatggtttcttatccgaaaatgcggactttgctgaacaagttgaacgctcaggttttatttttatcggtccaacagcggatgttattcgtttaatgggtgataaagtttctgcaattaatgctatgaaaaaagccggtgttccttgtgtacccggatcagacggtcctttaggtgccgatattaataaaaataaagaaatcgccaagcgtatcggctatccaattattattaaagcctccggtggaggtggtggtcgtggaatgcgtgttgtacgtgatgaaaaatcattggaagaatctatcgctatgactaaagctgaagcgaaagcggcttttaataatgatatggtttacatggaaaaatatctggaaaatccacgtcatattgaaatccaagttttagcggatacacatggaaatgccatttacttagctgaacgtgattgctcgatgcaacgtcgccaccaaaaagttgttgaagaagctccggcaccgggtatttcagaagaaacaagacgtgatattggtactcgttgtgctaatgcctgtcttgaaattggctatcgtggtgccggtacatttgagttcttatacgaaaatggtgaattttacttcatcgaaatgaatactcgcattcaagtagaacatcctgtaaccgagatgattaccggtgttgacctagttaaagagcaacttcgaatcgcagcaggatttccgctttcaattaaacaagaagacataaaagttaaaggtcatgccatcgaatgccgtattaatgcagaagatcctaagacctttttaccatcccccggtaaagtaacacacttacattctccgggtggtttcggtattcgttgggattctcatgtttatggtggatatacagtgccaccacattatgattcgatgattgctaaattaattacttatggtgatactcgtgaagtagcgattcgtcgtatgcaaaatgcattatccgaaactattatcaatggtataaaaaccaatatacctttgcataatttaattctttccgatgaaaatttccaaaaaggtggaacaaacattcactatcttgagaaaaaattgggtatgagagattaatatcactctcattgagttataaaaataaaagcaaaagtggataatagtatccacttttttatggataaaaaatgaaagtacattacaaacaatcagctaaagaatctcgctatgccttgtgcttaacagtgctatatcttatcggctggtgcatttttgcctatttacctgatgaggcaagaggtccgcttggttttcctctttggtttgaattgtcttgcatatactttcccatagtgtttattatcatcgtgtatttgtgtattaagttcttttttaagaatctatcattaggagaggaaaaatgaacattaatatcattttacctttggttctctacttgctctttgtattcggcattgcttactattcctatcgtcaaagaagtcaaggcaatttcttaagcgaatattatattggtaaccgctctatgtcaggctttgtattagcgatgacgacagccgccacttatgttggagcaggatcttttataggcggaccgggtgccgcatataaattcggtttaggttgggtattgttagccatgatccaagttccggtagtcttgtttactttaggggtactgggtaaaaaattagccatgctggcacgaaaaaatcaaagtttaactgttaatgatattttattctctcgttataaaaatccctatattatcctactggcaagcctttcattgctgttttcgttctttataatgatgtccgtgcaatttatcggcataggtcgtttattagaaactacattacatatcgactaccacatttcagtactcatttttgctaccactgttggtatttacacttttataggaggctttagagcggtagtactgaccgatactatccaaggcctcatcatggttttgggaacctttttattactgggcggtgtcatttatgcaggaggcgggattagccaacttattgatcacttagctaaaattgatccgcacttaatcacgccttatggcactgatgacagaccgcttgattttacatttatggcttcgttttgggtattagtctgctttgggttactaggtttacctcatacagttgtgcgtgctattgcctataagaatagtaaggcattacatagcggtattattatcggtacaatcgtcatcgctgtactaatgctcggaatacatttagccggtgctttagggcgtgctgtaattccaaccttagatgtaagtgataaaattattcctactttgatgatacaagtattaccacctgtagttgctggtatttttcttgccgcaccaatggcggcaattatgtcatctgttgactctacattaatccagatgtcctctactttgattaaagatctatatttacgtttttaccccgctcaaatacacaatgaaaccggaataaaacgcctatcaatattaacaactttatttctaaccttactcgttaccatagcaaccttaaatccgcctgatatgttgatctggttaaatttatttgctttaggtggactggaaaccacatttctatgggttatgttatttggcctatattggaaaaaagctaacgcttatggtgctattagttcaatgttagtcgggctaataagttacatattacttaccgctcttgacataaaattatttaatttccacgctattattcccgctttattatttggcttaattgcattcttattgggaaatcaagtaggaaataaattgattaaaaatgaggaaaaataaatggcttggatacaacttcgtttaaacagtacaaatgaaaaagcagaaaaaatcagtgaatatttagaagaaatcggtgcagtatctgtcacttttatggatagtcaggatacgccgatttttgaaccgctaccgggggaaacccgtctgtggggaaataccgatgtgattgccttgtttgatgcaaaaaccaatatgcaacaaattgtccgcctattgcaacaaaaaaatcatcttgatgaaaatactgcttataaaatcgaacaaattgaagataaagattgggaaagagaatggatggataatttccatccaatgaaatttggaaaacgcctatggatttgtcctagctggcgtgaaatacctgatgaaaatgcgataaatgtcatgcttgatcccggtttggcttttggtacaggcacacatccgacgaccgcactttgtttagaatggttagacagcttagatttaacaggaaaaactgtgattgatttcggttgtggttcaggtattttagccattgctgcccttaaattaggtgcaaaaagtgcggtcggaattgacattgatccacaagctattctcgccagttataacaatgctgaacaaaatggtgtagcagagcgtttacaattatttttatcagaagaaaaaccaaccgatttacaagcagatgtggtgattgccaatattcttgccggtccgttgaaagagctttacccgataatcagcaatttagtcaaaccacaaggtgatttgggcttatccggtattctatctacacaagcagactccgtttgtgaagcctatcaagggaaatttactcttgatccgataactgaacgagaggaatggtgccgaattaccggaaaattaaactcatttgtctaattcatttatatgattttatacaaaaaataaaagtaaatgatataaaatttaaccaatatcaaaaaaatgtaatttgtataaaaaatattctttgcaaatgacttaaaagtgcgtatcataacgcaccttgtcgccttgactagcgaaagcaataaatctgatatagcataatttggagaagcagaagtgcaaattggttcttatcaattaaaaagtaatgtacttttagctcctatggcaggcataacagatcagccttttagaaggctttgttctttttatggagcaggtttgacttgctctgaaatgatgtcagccaatccacaagtttggcatacagaaaaatcaagattgcgtcttgcccatcatcaagatgcgggaattaacgctgtgcaaattgctggttccgatccggttgagatggctcaagccgcacaagtgaatgtagaatatggtgcacagattattgacattaatatggggtgcccagctaaaaaagtgaaccgtaaattagcaggatctgctcttttacaatatcctgacttagttaaaaaaattctatattcggtagtcaaagcggtaaatgtaccggtaacattgaagattagaacaggctggaatcaagagcatcgtaattgtatcgacattgcaaaaattgctgaacaagcaggaattcaagcattaagcatacatggacgtacacgtgaatgtttatttaatggaaatgctgaatatgacagcattaaaaaagttaaagaacaaatttcgattcctgttattgctaatggtgatataacaaccgcaaaacaagcacaagaagttctcagttatacgggaacagatggaataatgattggacgtggggcattaggtaaaccttggctatttcagtcaatagtaagcttaatcgaaacaggtatcactattccggagccaagtttagatgaaaagtgcagcgtgattttgcaacatattcgtgatctgcatcagttttatggtgaagataaaggatatcgcatagctcgtaagcacgtatcttggtatttagagggaattcaacctaattccgattttagacagacttttaatgcaattacgaatgctaaagcacaactaattgcactagaagatttttttaattttattttattggataaagaaacatgttagaacaacgtaatccggctgaagcattaactgtttcagtattaaattcacaatctcaagtaacaaataaaccacttcgtgattcagttaaacaagcattaagaaactatttatcacaattagacggtcaagatgtgaacgatctttatgaattagttttagcagaggttgaacaccctatgttagatatgatcatgcaatatacacgtggtaaccaaacacgtgcggcaacaatgctgggcattaaccgtggcactttacgtaaaaaattaaaaaaatatggtatgggttaatttcccttgctgaaaaaataaggtcgctaatttggcgaccttttttaattactctatttcaatttttttaataaattccgaactcaaatctaacaacggtaaatccgagccttgccaagaacgtaaaatttgataatccattaaacttaatgtatccaaccctggagtaacatttggtgtatattgttttgcgatacgagctaattgggtcaaccctaaactgctttcaatagacgagctgatcactgcttttaagcccaattgatgtgctttttcgattaatttaacacaatcttgcaacgaaccaatcaaagtaggcttaattacaattgctgctaagtgcggttctttttctaatttaaatccttgttctcgaatactttcgtcccaagctaacgctatacctgtatcctgtgcaaattgacgactatcgtcttgcgtcttacaaggctcttctaagaactgaatacgcttgcgatgttcaggctttacatatttggcaaacaactgtgctttcgacaacgtccaactgcgattagcatcaagacgcaaataaagatcaggaattgcttctaacaacatatcagcaatcataccatcacgatttgcttcatacatgccaaccttaattttagctaccttctcccctggaatttgatttaatacatcataaagctcatcaggatcgccgtaacatagcggggcgacttgatagtttccttcttgcaccaattctccttccatttcagccaaagcacaacttaagccaaaagcaacagacggatatagcccttgcaatgaaaatttttgatttgcagatcttgcctgctcccacttttttaaccattgaacagtttgctctttcgcctgttctagagtttcttggctaaattcaggcaacggggcaatttccccccaaccttcatgctctccacattttatttgcacaaacaacccttcacgtttcttcaaaaagcgattacgcaaaataagctgactatccacaggaatagcatattgatataaatgaaaagtccgatttgtcattattgttcacattgttgtgtgttgtcattataacgaccaccataatctaagcagtgatcttttgcatcaaaaataacgaaagtggcaaaaatacctagcaccactaaaatcagtaaaagaaacaaccattttttcaacattattttttcctcaaacaagataaaagtgcggtcaaattttccactattcttaccgcacttttactgattaaatttatggatttcgcttaaatttactgaagtcaggtgcacgtttttcattaaacgcattgcgtccttcctgcccttcttccgtcatataaaataacatagttgcattacctgccagctcctgtaaacctgcttgaccatcacagtccgcattcaaagctgctttcaaacaacgcaaggcaatcgggctgttgcgtaacatttcacgacaccaacgcaccgtttctttttctaaatcagcgtaaggtacaactgtattgaccaatcccatttccaatgcttcttgggcattatattgacgacataaaaaccaaatttcacgtgcttttttctgcccaacgatacgagccatatagcttgccccccaaccaccatcgaatgagccgactttgggacctgtttgcccaaaaatcgcattttccgctgcaatagttaagtcgcataacatgtgtaaaacatgtccacctccaatcgcataaccggctaccattgccaccacaggttttggacaactgcgaatatcacgttggaaatccaacacatttaaatgatgcacaccgctttcatctttatagccaccgtaatcaccccgcactttttggtctcctccggaacagaaagctttttccccttgaccggtaagtacaattacaccaattttttcatcaaaacgtgcatcggaaaaggctcgaatcatctctttaactgtttgtgggcgaaaggcattacgaacctcagggcgattaatagtaatttttgcgataccgtcagtagatttatgatacaaaatatctgtataacctgaactgaaatcctgccattcaacaggcacataaagcacatcatcatttggattttgcattatttattccttttttattaagtcaatttgtggttggtattatagcttaaataccaataaaaagtgcggtcgtttttgtggaatttttacttggaacagcccattactccgtagcatattgaataaccttcgtgtatgctcatactgagttaattaatctatctgaacaaaaaaatcgcatgaataattagtcatctaaaaccgaatacaccatcttatttattctgcataattaaaaaaacgccacagttctatctgtggcgtttccaaatttgagcaaaataaattatgcttgacctttaaccgcttttaagcctaaaaacggtgctttctcacctaatgcttcttcaatgcgaattaattggttatattttgcaatacggtcagaacggctcatagaaccggttttaatttgaccagctgctgtaccgactgccaaatctgcaattgttgcatcttccgtttcaccggaacgatgtgaaataactgcagtataacctgcatctttagccattttaatggcggctaacgtttcagttaatgaaccgatttggttaaatttgatcaagattgaatttgcaatccctttttcgataccttcttttaagatcttcgtattggttacaaatagatcgtctcccactaattgaaccttatcgcctaatactttggtttgatatgcaaaaccgtcccaatcagattcatcttgaccatcttcaatagacacgattggatattctttgcataacccttctaagtagtgagtaaattcttgagaagtgaaagatttaccttcgcctttcatttcatacataccgttttctttgttatagaattcggaagaagcacagtccattgccaatgttacgtctttacctaatacataacctgctttttctaccgcttctttaatgcaagcaagtgcggcggcgttagactcaagattaggtgcgaaaccgccctcatcacctactgcggtgcttaatccttttccttttaacactttcgcaagattatggaacacttcagccccaatacgtaaagcttcttttaatgttttcgcaccgaccggttgaatcataaattcctgaatatccacattgttgtcagcatgttcaccaccattgatgatattcatcatcggcaacggcatagaatatacacccggtgtaccgttcaactctgcaatccaagcataaagaggcatacctttagaggcagctgccgctttagcatttgctaaagaaaccgctaaaatagcatttgctccaaattttgatttattttccgtaccgtccaattcaatcatgatttggtcgatttcagcttggttgcttgcctcttttccaactagtgcggtagcaatttcgttatttactgctgaaacagcttttaatacacctttacctaagaaacgagctttgtccccatcacgcaattctaatgcttcacgtgagcctgttgacgctcctgatggtgctgctgccaatccaacgaaaccaccctcaagatgaacttcagcttcaacagttggattgccacgagagtcgatgatttcacgaccaattactttaacgatttttgccattttgttttccttctatagttaatctaaaataagtataaaaactggcgatatagtaaagctatttcgtatgtttgtcttgtaaaaaagcactttttttgattttaatccatataaattgaaagaaaaaatactcttatatatttatttttgtaattttataaaattacaattatttatattgccagtatggagaatatttattaaaattctgctatgtcatttaaataaggtatagttttatgttgttaagtaatattgtggagatcagtagcggacaggcacagtttcgtatttccgaagtcagtgatccgattgcacctgtttatacttattatagccaggcaaacttagaacaagatctctatttatctgatggttcagcagtacttcctaaagaaataaaaacttttgataaaataaccagtttactttccactggtgatgtgatttttagtctgatttcaggtaaggcaacgattgtcagcaaacaacaccaaggttttttatatactcaaaattacgttaagttaatacctaaaaatcagatagatgccaattatttagtctatttattaaacgaaaatgcggtggttaaaaagcagttaagtcgtggtttgcaaggatctcaagtattgaaatatacaactaatcagctgaaatcattgagattacccaaattaccccacttatcggaacaacgtttaatgggagagatttacctaaaacaacaaaaattagcttatctcaaacaacgcatagcgaatttagaaaaattacttgtgttacaccaattgcaaaagcgagtacagcatgactaagaatatacccgaattaaaatttgaaaaaaccttaattgaatatctttgtacaggaacgattacggcaacggataatataattggcgagccgcctgcggattatgtagtgcgtaccaaattgtggcaatatgagccaagcattaaaacgacggaagatttatgggaaaattttaaaagaattttagaaaagctcaatcaaaaaaccttagatcgtcctttaagtgcggtggaatttgcacaagttaaacgtactatttctaatttatccacgccttatgccgctgggcagtttctttatggcacaaacggtgtatcacaaattgaaattgatttagatgatgatcgtcatgtgtttttaaccgtatttgaccaaaaacaaatcggagcgggcgatacggtgtaccaaattgtgaatcaaattaaacgaccggcgattattgcaggaaaagaaaatcgacaatttgatactacgttgttgattaatggcttgcccattattcaaattgaagaaaagaaagaaacgcatgatattaacgaagccttaaaccaaatgcaccaatatatcgcggaaaatcaatacagcgatattttttctacgttacaacttctgattgcgattacgccaaacaatgtgaaatatatggcgaataccacagcggatcgctttaataaagattttgccttcaactggcaacgtcaatcggacaataaaccggtttatcactggaaagcctttgccgattccatgttgagtattcccatggcacatcaaatggcgactaactatatgattttagatggtacgccgaataagcaaaccctaaaagtaatgcgaccttatcaagtttatgctacgcgttgtgtgatggataaactcaaacgggcggatttcgatcaagcgttgaataaactcggttatatttggcataccacaggttcaggaaaaactattacgagctttaaaaccgcttggctggcaagtcgttcgccgaaagtggataaagtggtttttttagtggatcgtattgcactgactaaccaaactaccgaaaactatcgagcttatgatcctgatgccacggaagatagtctaggtagtgtactggataccaacaacaccacagatttgaaccgcaaattacacagcaaaggcagtcaaattattattacctctgtgcaaaaactggataccttggttaaacgcacttctttcaaagcacccgaaaaaaacattgtgtttattgttgacgaagctcatcgttctacaggcagtgataattttgctgcgattcaaaaaaaatttaaacattctgcgtggattggttacaccggcacgccaatgtttgatgacactaccaaaggcttacgaactgaagatattttcggtgaactcttgcacgcctataccattcgagaagcaattgctgatcgtaatgtgttgggttttaaagtggattttgaaaccacgattagcgaaaaaagtatgaaagaagcacatctaccgaaattctatcgccttaaatatcctcattggacggaagaacaaattgccttgaagattgccaatctcacgcaacaagatatggacgacagcatcgaaccgagtttttatgacgaaaatgaagaacacgtcagattagtggtggaagatattttcaaacattggaaaaatcgctccaattgggataacaaacgtaatcgtggacaatataacgccttgctgactacgcacgtgggcggcggcaaagccagtacaccaatggcaatgatgtatttccgtgaattccaacgcatcaataaagtgcggtcagaaaagggggagtttttgctaaaagttgctgtgacctttagccaaaataccagcaataacgacaccatgcttgaaaccaaccaaggattattcgaggcaattcaacattacaacagcgaatttggcactaacttcactatgtctgatgtatcggcttatactcaagatgtcaccagccgtttaaatcgcaccgctgtggacaaacaatatttagacctcgtgattgtcgtagatcagttactaacaggatttgacgcccctgaattaaatacgctttatgttgaccgcactttaaaaggtgcaggactcattcaagcctattccagaaccaatcgtgtagcggatatgcgtgaaaaaccttgggggcgaattatcaattaccgctggcctgcccataatgaaaagttaatgaatgaggcgttgtccgtttacgccaacaaagattccgccaaattatccgatgaagagcgaaaagtgaataataccaagtataagattactgcaccaaaatacgaagaattgctcgatgacaccaaacagattgtggaaaatctgcgagaaataacggataactttagccaattgccaccgtctgaagcgaaaaaatgggaaatgttggaacaattacgcacctataccgccaatattgccaaaatcaagcaatattctgcggaagatgaaaatggtgaaattatcggttttgattatgaaaatccggataaattgattcaagaactcggcatgaccagtgaagaagaaagtatgctcaccaacacattgtccaacgaactcaaactgcatttagcaaaaagccgaaatgtgccagtgatacaaattgagctacaaatgacccacattaaagacgtggaaattaattacgattacttaactgaattaatttccagcttgttggcacaagtagaggcaggtgaaacggaaaaagccaaagaaacggaaaaagaattggaaaaatttgccaacggcttggaagatcgcagttttgcacaacgcattaaccgtgcggcaaaagcgattatgaaaggtgtgttcaaattaaaagatgggtttaaaaaagacggtatttctattgtggaacaagcgaataacgccaaccaagatcaacaatttttggattttcgtctccaatggggattaacggaggtgattaccaacgcccaacttcgacagcttttttccaaacatcaatttcaacaaaaagatttagatgacaataatcagcttacggatttaatcaaacaagcaggtctcacttatctcgaacttgcacaaaatgatgaagtaaaaaaactgacaaaaatgaaataccgtaaccagttgcgtcatgctatttacgaacttgcagatgagtttgtgggggaataaataatatggaaagaaaaatcaaatcttggaaagattatgatgacttacttaagttattgagcattcgaaaaatggatgttgaaaatcaacaacgtacattacattatttaaaaaatataggatattaccgattaagtggatactggtatccatttaagcaaaaagatgagcaaaattcccaaaaagaacaaaaaactatattactagatgagtttaaaacaggaacttgcttttcagatattttagccctttatatttttgataaacagttacgttttttagcgttagatgcactagaacgtattgaaatggcagttagaaatgatgtggtacatttattgggtaaattacatccactggcacatattgagccttatcaaatagatcaggatacaggaaaaaaagtttgttatttacatcctaattttattgcaaaaggggataaatattccaaatggaaagataagcataatcagcttattaaacgagctaggaaccgagatgctattaagcattacaatgaacaatatgccggcgtattgcctatttgggtttctgcggaagtttgggattttggcttgttatcccagttattttcagggttacggtataacgataaaaatacgattgccgcaaaatatggcgttaaagacggaaaaacatttgaacaatggctaaaaagtttaaactttattcgtaatgtttgtgctcaccatagtcgtttgtggaatttaaatatcattaatacatcggcaccactagaagaactgagttcaataaatcaatatcgtatcttcatgtacttgtgtatgatgcaaaagttattgacaataattaaccctaaatccacttggaatgagcggttatatcaattactaaacacattccctgaacctaaaaataaggcggtttcagtgcatgacataggattaccaaaagactgggaagaattagaaatttggaaaaatattaaagacaagaaatgagaactgacgcgtgcaaaagcagaggcgtcagtcatattggtgctgatagtatcacatcttatattttttgaaaaggatagaaaaacaaaatgaataacgaaaagaaacttgtaccgaaattacgattccccgaatttactcacgcttgggaacagaggaagttgggggatttggcaaattctataaaatcatacccattatcaagaaatgtggaaactgaagagaaaaccaaaactaagtatatacattatggtgatattcatcggggtattgctaatattttaaatgatataagtgtgttgcctaatattactggagaatattcagaacttttaagttttggtgatcttgttgttgcagatgcttctgaagattattacggtgttgcagctccgtgtgtaattaattgtatttatgaacaaaatattgttgctggattacatacaatagcaattcgcccatataagtcccatcatttatttttatattatttattacattcttcaggctttaaagagtattgcaaaaaagtagggacaggaacaaaagtttttgcgattacatcaaaaaatttattaggctttgaaagctttttcccacattacgaagaacaacaaaaaatcggtgcatttttcaccgcacttgatcgctacatcaccattcatcagcgtaagttggaaaatatacaaaaattgaaaaaatcattgttgcaaaaaatgtttccgaaaaatgatcaagaatttccggagattcgttttcccgaatttacttacgcttgggaacagaggaaggcaaaagaaatctttattagcgtttcagaaaaggggttccctcacttacccgtattatcagcctcccaagaatttggaatgattagacgtgatgatattggtattgatattaaatatgatcaaaaaagtacacaaacttataaaagagtaagcccaggacaatttgttattcatttgcgttcttttcaaggtgggtttgcatggtcagatatagaaggaatcacgtctccagcttataccatcattgattttaagaaaaaagaaaatcattcttctaacttctggaaacttatctttaccagttcaagttttataaaaaaactggaaacagttacttatgggattagagatggaagaagtatcagtttttccgacttttcagatttgagattattttattctcaaatccaagaacaacaaaaaatcggtgcatttttcaccgcacttgatcgctacatcaccattcatcagcgtaagttggaaaatatgcaaaaattgaaaaaatcgttgttgcaacagatgtttgtttaataaggggcaaagatgagctattccattgaatatacacaagaaattgatcggttaagcaaagaaaatgcctatcgactttatgattcaggcgatattcatcgcttagaagtcgggacgacgaaaggcttgcaagatattcatcgttatttatttcaagggctttatgattttgcaggcgaaattcgtgaattaaatatttctaaaggacattttcgttttgccaacgcactttatttaaaaccggcgttaagtgcggtggaaaaaatgcctgaatcaacctttgagcaaattattgaaaaatatattgaaatgaatattatccatccctttttagaaggaaatggtcgttctacacgtatttggttggatttgatttttaagaaaaacctaaaaaaagtggtgaattggcagaaagtggataaaaagttgtatttacaagcgatggagcgtagccccgtgaacgatttggaaattcgctttttattacaaaatgcgttaacggatcgcattgacgatcgtgagattttcttgaaagggattgaacaatcttattattacgaacaagccgaataaactaatttaaagtgcggtcataaatacagaattttttaataaaggaattaaatatgagcaatgtacaaacaattaccggtaaactttgggcaatggcaaatgagctgcgtggcacgatggacgcttcagaatataaaaactatattcttgcctttatgttttatcgttatttatccaaacaccaagaactatatttggtcgataatcatattttggacatagagccttcgcaaagtgtgaatgacgcttatttaacgcaagccacaggtgaggaattacaagattatttgcaagatatttcagccagtcttggttatgccattaatcccgaagatacttgggattcattaatgcggaaaatttacaatgccgaagtgatgccaagtgattatcaagccttatttgataacttcaaccaaaacgccaatttaaatgaagatgcggtgctagatttccgtggtgtgtttaatgatttgaacttaggagcttctcatttgggcaattctaccaatgaacgtgcgaaatctttaggcaatattgtgaaattggtggacgagattgaatacaaagatgatgacggtcgagatattcttggtgaaatttatgaatatttgatcgggcaatttgccgccaatgcaggcaaaaaaggcggggaattttatacaccgcaccaagtttcaaaaattttagcgaaattagtaacgctggatgtggcagataatcaagagactttccttgtttacgacccaacaatgggatcgggttcgttattattgacggtaggtaatgaattgccacaatcgaaacccattaaatattatgggcaagagctgaacaccacaacgtataacttggcacgcatgaatttgatgatgcatggcgtatcctataaaaatatgacgctatccaatgctgataccttagaaagtgactggcctgaaggacttgatgcacaagggattgaccaacctttatgtcgttttgatgctgtggtggcaaatccgccgtattccgccaagtgggacaatcacgagcgtaaattaaaagatgcccgttttcaaccttttggtgctttggcacctgcttcaaaagccgattatgcctttattttgcatagtctatatcacttaggcgagcatggcacgatggcgattgtattgccgcatggtgtacttttccgtggtgcggcagaaggtaaaatccgtaaggcattgattggcgataacaccagcaatgcacaaggaaactatttagacgctgtgattggtttgccggcgaatttattctacggcacaagtatcccaaccacgattttggtttttaaaaagaatcgtaaaaataaagatattttgtttattgatgccagccaagattttgacaagggaaaaaatcaaaaccgcttaacagacgagcatgtccaaaaaattattgacacttaccaagctcgtcaaaatgtggataaatacgcttatgtcgcttctcttgaagagatcattgagaatgactataacctcaacattcctcgctatgtagacacttttgaagcagaggaggaaatcaatattaacgaggtgttaaaacaacttcagcaagataatcaagaaattgcacaattagaaaaagaaatcaacgaacagttaaaattattgggagttgaacttccataacaaggaaagagataaaagaggcaaaagcctctttttttataaaattttgcataatgttaccgcacttttgagaaaaaaactyacgcttgggaacagaggaagttaaaagaaatatctaaaaaagtaactgaaaaaaatactaacaatcaatataccgaaactttcacaaactcagcagagttcggcattattaatcaacgagatttttttgataaagatatttcaaattcagctaatttagatagttattacattgttcaaaatgatgattttgtatacaacccacgtatttcaaatttagcacctgtgggaccaataaaacgtaataaattaggaagaacaggcgtaatgtcgccactttattatatttttcgagtaacaaatgtagagcagaattttttagaaattttctttgaaacttcaatttggcataagtttatgaaagaaaatggagataatggtgcaagagcagatcgtgttgctatcaaagattctctttttgttgaaatgccaattagtatcccccaaccccaagaacaacaaaaaatcggtrcatttttcaccgcacttgatcgctacatcaccattcatcagcgtaagtaatacatacaaaggagatatattatgaacgaagtaaattcaaataaagagctgttttatcaatactattcacgctggattcatatgtacaaagagggggctattagaaaagtcactatggcaaagtatctaatgacattagagtggctaaaaaaactgattccaaatctcttgttgtgtgatcttaatcgcataagttatcaacaattactcaatgattatgcctgttatcacgaaaggcagaccacgatggattttcatcatcaactgaaaggtgcaattcttgatgcggtagatgaagggttattaccaagagatcccacaagaaaagccattatcaaaggtcgcccacctcgtttgaaaaaaacaaaatacttaaatcaatttgaactgcatacattaattacacaattaaatttaaccaaagaaattaactgggattggtttattttattaattgctaaaacagggatgcggttttcagaggctttggcattaacaccaaaagattttgatttttcacatcaaacactgacaattaataaaacttggaattataaagatggtggtggttttcagcctacgaaaaatcgttcatcagtacgaaaaattcctttggattggcaaactattattcaatttgctgagttaattaaaaataagcctgaagaacagcctatttttgttcgtaaaaaaatttttaattccacagtgaataatatcctgattaggcgttgtaaaaaagcaaatatcccaattatttcactacatggtttgcgacatactcatgcgtcattgttgctattcgctggggtatctattgcaagtgttgcaaggcgtttaggacattcaaatatgacgaccacgcaaaaaacatatttgcacattattcaagaattggaaaatcgagatattgatattgtaatgcgttctttatcaaatttaagttaatttagagctacgtcacttacgctgatgaatggtgatgtagcgatcaagtgcggtgaaaaatgtaccgattttttgttgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatacaattaattacacacggagctgcaacaccgtaataatcttcagaagcatctgcaacaacaagatcaccaaaacttaaaagttctgaatattctccagtaatattaggcaacacacttatatcatttaaaatattagcaataccccgatgaatatcaccataatgtatatacttagttttggttttctcttcagtttccacatttcttgataatgggtatgattttatagaatttgccaaatcccccaacttcctctgttcccaagcgtaagtttacataaaacaaaaaggctatcaaatgattgtatgatagccttaatgagataacttaaatttttctattttatactataattattttctctgattttccttagtcgcttttacaccacgatagtcaaagctactgggaattaaaatacctatgcctttcgtttcgacatcttgcgaatcaatgtatttaatattaacttcacctattggatttgcttcttgataaaacactttttccccattcagataaatccgcttcttgacaatcaagaaaaaattgctataaagcactctatttttgttcatgaaaaaaggatattatgtcaaaactttattatcgacctgaaattgacggactgcgtgctgttgctgttttatccgtcatattatttcatctaaatccaacttggttaccaggcggttttttaggcgttgatattttctttgttatttccggctatttaattacttcaattattagccaagagatccaaaataatactttttcctacaaagatttttataatcgccgtattaaaagaatttaccccgtttttattttagtactggctattgcttctgtgcttgcttcgttattttttgttcattatgaatattcgcaattccgaagaattatcaactcagcagcactatttgtgtctaatttttatttagctcatcgacaaggttattttgacttatctgccaatgaaaatcccattttacatatttggtcattagcagttgaagagcaatattatttatttttcccccttttattggttgttgcctataaaaaatttaaaactcatcaagtatttaaacctatagtattaggtttaaccttactttttattttaacgtcatttatccctcaatcaatttatatcaaaatcggttggagtaatacttattacatttctttcatacgttttccggagcttttaatcggatcttatcttgcattaagtaaaccaagagtaaagcctgctaatcattttgttggtttcggtatttttattgcacttatcttaacgctattcttttaccataaatcaatgccgttaatgccaggcattgttctactcctaccttgtattttaaccgcacttcttattcatttctcctcccaaaactcatggggggggggggtaaaaactctcttatcattaaagcccatcgtatgggtaggtaagttatcttattctctctatctgtttcattggatttttattgcttttacgtattatatttcaggtgaaaaggaacttcctcaaggtgcaattttaccagacagtgccgtaaagccccgtcctttaggtcggggatataaggcacaaacggcgtagccgtttcaaacctaactaatcaggtgtttgttgttgctcaatgtattggcgaataatagatataggtgcaccaccgcaactacttgcaaaataagacggagaccaaagctgatttccccataattttttgcgaatactcggatagtttttctttctaatcattctgcttgaaacgccttttaaactgttcacaagatttgatatagctactttcggtggatattcaacaagtaaatgaacgtgatcgtcttcgccatcaaattctactaattttgcttcaaaatccgaacagacggattcaaaaatcgcttttaagtcatcaagaataaatttagtaaaaacttctctgcgatatttagtcacgaaaactaaatgaacgtgtaagttaaaaacaacgtggcgaccacgtctaatctctgtttcttttttcatagaccaagtgtagaataataacaatctttgtattctaatttgtgcaatgttactccgtaaagcctttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcaaaaactgaaagaaaaaatcagccggttgcatcataaaatcgccaactgccgaaaagattttttgcataaaatctcaacccaaatcagcaaaaaccacgcaatgatctatgttgaagatttgcaagttgcgaatatgtccaaatcggcaaaaggcacagcggaagaacacggtaaaaacgtgaaacagaaatcaggtttaaaccgtgcgatattagatcagtcttggtttgagttcagacgacaactgggctataaaacgcaatggcttggcggatttttagttgctgttccagcacagaatactagtcgaacttgcccttgttgtgggcatattgcaaaagaaaaccgtgaaactcaagctcattttaaatgtgtagaatgtggctatacagaaaatgccgatgtagtgggagcaatgaatgttctcacacgtgggcaagcaatagtccaagcataataaatatcagggtaggacatacccgaagcgtctatgaagtgaatctcaatagagatcagcagtagaaacccaccgagagtagcccacagcttgctgtgggagctagtaggaatcccctgcctttaggcgggggaggatgtcaatatttccacgcacttgaacaaagcaagtgccagccgtgagaagctgaaaaatacaaaggcgaatagcacgcctcaagcgtgtttttttattcgtaatttacgcacacctaaaataaatctagcaatagatctattctcaatggtagagcgtaaagggcaaccgcttgcggttggctatgttcctttgtacgtagtttctcacccctttacgctttaccgcccgaccgtgagaagtctagcggaaagccttttaaacattacaaaggacaccgcaaaaatgctttataaattcattttattaggagaaaaccgcctaaaactttctatacgtgctaaatctgaagctgaagcacgccaacaactcaacctttctaaaaaccaagccttatttattggtcaaatcaatacaagggggcgttatgtctaatcgcaacctatcaaacgaaatcaccacgcttaaagctacattaaaaagtttactttcaacttttcaaactagccgagcaaagcgacaagttaaaatccaaatattcaagctataaaggagatttagatgatgagtaatacaaattatcaagcaaaccaagaaaacgcatttaagcccgatttagagggcattaagaacacattagaaacctcaagagatttaattattcagttaaaagagaaaaagcccgtaatagcttttaatgacgaggggcaagaggttcagttatctcaagaaaaaatactagacatagtactaacgaaattattctgttctattgacgatattgacgaaatacagaccgcacttttaagccttgtagcgatttgagccgatagcaaaaacgatagaagaaccctaacaaaaaagccctcaaccaaatggcaagggcacaagtaatttaacttaactcataggaagtaatcaatatggagttctaaaaagaacgtcatggattatagcctaaatgagtttgaaaaggtacagaaacatgacaaaaatcaaattttcagtattgctaaaaaatcaaagtgcggttagtattggcgacactactacaattgagggcaggcactacccttattcaagtgcattttttatttctcaaaatcctttcaataacatcgctattaattggcgttgtctatctatcgattttgcgaaatggtctatatgtcgagataaggcggagtttatccgcacgaataaggcaagccgatcaattgcggtagttgaagccatttcgcaccctattaacaggggcgatacaaatcacttactaactaaacaattgagaacaatcaaaatgctattcaaatttatcctattcttaggcaaaaaccgtctaaaactggctatacgtgctaattcagaacaacaggcacgcaatctattaaaccttaaatctaacgctttatttatcgcacgcattaacgacaaagggggtatttatgcttaatgagatagaacaaaatcaccgttacggcgtaatcctaacctatgaagacgggagaacgtttgaatgtgctgagggcgtaacccatgctagagccttagagattaaagctaatgctaaaaaacaaattcaagcaaaagagttagccttttttgatgtattgacatcctcccccgcctaaaggcaggggattcctactagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacatttaaaatgagcttgagtttcacggttttcttttgcaatatgcccacaacaagggcaagttcgactagtattctgtgctggaacagcaactaaaaatccgccaagccattgcgttttatagcccagttgtcgtctgaactcaaaccaagactgatctaatatcgcacggtttaaacctgatttctgtttcacgtttttaccgtgttcttccgctgtgccttttgccgatttggacatattcgcaacttgcaaatcttcaacatagatcattgcgtggtttttgctgatttgggttgagattttatgcaaaaaatcttttcggcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattctacacttggtctatgaaaaaagaaacagagattagacgtggtcgccacgttgtttttaacttacacgttcatttagttttcgtgactaaatatcgcagagaagtttttactaaatttattcttgatgacttaaaagcgatttttgaatccgtctgttcggattttgaagcaaaattagtagaatttgatggcgaagacgatcacgttcatttacttgttgaatatccaccgaaagtagctatatcaaatcttgtgaacagtttaaaaggcgtttcaagcagaatgattagaaagaaaaactatccgagtattcgcaaaaaattatggggaaatcagctttggtctccgtcttattttgcaagtagttgcggtggtgcacctatatctattattcgccaatacattgagcaacaacaaacacctgattagttaggtttgaaacggctacgccgtttgtgccttatatccccgacctaaaggacggggctttacggcactgtctggtaaagaaacctatattttcaaggttttcaaaaaggaaaatttataaacaatataccttgtagaatacctctggtatctaacaaactataaaaataaaacttttataatagctaacaatataggtataacaaaccaaattctataatataaaaaacggataaatctttttattattggttcagtttgttcttgatatataagttcacttgcatatatatcagataaatttttatatatttcaccattatctcccatgactatactttcatcattaaatgattcagcaatttccattaagacttttaatgaaatttcatcaggattagagagccataaactattatcatcataagatataaagaattcatactcatctttataaaaaattcttttttcataatctacggagaatcctaaactcgtcatcttgtttataacccgctcaaaatcatataatatcttatcagtactaagtttatctgacttatttacaatagatacatgatagcccatattatttttcctgcttatctgtaactgttttataaagttctatctaacaaatcgggttattaccacattcctcaagcatagctttacggttagattcgcttatgcctttatatttctcaaaaatcgctttcggctctttaccttctttctcagcttgagccagttctctaatatcacaatagtattatatttattttgccattctttatttgtttcaatttttcatttcttgctttgtatatatttattattttataaacatatgatccgatatttttttcagacatcaaaaaatctttccatataatagttttaccatcaaaaatatctatataatcccaaagggcatccaagttatttccaaaatattctcctaattctggaacttgcttggataattgcttataaaaatcatctggagaaaaaatttcctttccttcaattattatttccatcttccaacctctttaaatgttttataatgatctgtagtaataaataataaaccgtcacttgaatataataatctcgttcctagttgtttatttctacctatattgttattaataccaatatcagcctcataccaaactcttccatctttactaggtaataagttactttcgtttctaaaaatatccccaccaatttgcccttgttttaaaggtttgccacttgaccaattatataatttttagctatatccttagttacatactcatcaggtaattttccagtttttttcaaactatcaatgactagagcagtattttgttctgcttgtaaatctaattttaatttaggatacaacgctacattctcagccccgcttgatacccttagcttagcatcctgcttctcgtaaccttttggtggtgtaacaataggctgtctagtcagatatccttttatttcccttaaagataaagaaccaccacctacagccgccccagcttcaatagccatgctggcataatgaacactacttggcaaggctgcatagctgtttgcattctcatctcctacaaaggtcgccattttacctttaaggctattacttaatccatttacataagatatcactctcaacgcagaaaggtttttataaacttcatcattccctgttcccatttgataaatatggggaagataacaaatcgggttattaccacattcctcaagcatagctttacggttagattcgcttatgcttttatatttctcaaaaatcgctttcggctctttaccttctttctcagcttgagccagctctctaatcagcttttctacctcatagttattgagatagttattctccaccgcacttttcccaatctctccactcaatgctgcattttgtacggtgttcaccgtgctatttgattgattgttttatcgggattgtaagaaaaaatatccaaatctatattttcatctgtaaatatcttagagattatatatttaaatctctcatatctgtcatagatgtcagaattatatttagttaaaagggtaaaactatcccaatttggaattatcaataattcaattattcgcataatcccaattaaaatatcttgttttatcaattttgtgtttttataggttattgctatatttatcaaatctttttctagtttccaatattcatcatcattccattctgagtaatccaaccatcttcctataaatgaattttcatcatataaccttgaataggttacatttctataaaaatctgcgtattctgccatatttaatctccaattttatttaagttaatatcaaaagttccgtttcttgtttcttttttatttaatttttcaggactagccgcttctttccaagctcctccattatgaccatccacatctctagttatatagctattaccttttttaaacacaactgcaccagacttatcatcaaattttgttcactgactttttaaagtttgacgttttccttggttgtcaattgttttcaactctaatcccatcagctaattctaggtctaattccatatctatgatcaaatttataataattttttttgcatcattcgtaattgaaatttctctctcatataactgagtacagatcaactcaagagctataccatactcatcataattaattaaatccattgcattctcacaatcctcttcaggcaaatttttataaagcaaagatagtagatttttcattttttctttcattatattactcctgtttaatagggaatgcggtaattacaccatttcccattggttctacaataaccctaattctaacgccatcaacaactccctcaactttaaatctactcggaacaccctttttagtatacaaacttccttttgttcctgtttgttgtacccattctaaattaggatcagtagcaatattagatataacgtcgagaatttttttctcagaccagtgtattgggaatttagattttccattcagaatatttgtaaaagaaaatttatgcccaccacctgttttatctccatataatatatgttcagctctctgagaactgactagagataccatattttctctagcagttattagattagagacatttttagtaacaactttttgaaatacatttatagcttcacccgtcaataaaatactcggtgcttccaacgatttacccagactaagcatatagccttgcatttctgcggctaacatagagtcgttttctaaagcccaatttaactgctcattccattgttccgctgaaatcaccactttatcaaaggtctctttcgggttttggattacattcgccagtgttgcaacggttttatcaagatttactatcccatcaactgtgccttgtacaccttctacaaccgctttagcttccccaattttcattgcatcataataagcttccgctaattcctccgcattttctttatctttgaaaagcgttttggcaaacatttctatcgattgcttacgttcttctgatgggtgaatgtcatcaccaagaaaattaaactccaccgcattctcagccaccctcattcccgtactcactgtcgccaatgtaccggctgcggtatcactgcctgcagctacaccacctgccacacctgcaatccctttgataacctgaataagttcttgcttttccatttccgtcagttctgttggggatttgccatagacggtttcgcttaagattttcgcacccacttcacccacgcctgtagccactgcacctgccgtcgcactactgcttgataactgggcttccattactccccataaaatatgagcaggaatatttaaggcttgtaactcagggctgtctgtcactttcttaatcgcttcattcacataaggcgatacggcacctgctacaaccgcttctgtcggtttccctgcaacaataaggcttaatgccgcagcgactgcggttgccgcctgtttcttgttaccacccgtttgccattcttttgcagcttgttggtaagcggtagcttcttgggctttttgggttgcagtaacaaggtcgccttcttcagccgctttcgttgcctcttgctctgcttgttttgctttttcctccagttccgctgcttgccggctggcataggtcatcaccgcacctgcaacattgcctgcctcttgtgaaaggatttgttgttctttcaacaccttattaatgtctttcggtgcttcaacctgtttattcgccttatcaagttcggtattaatccccaacgcttttgctgtggtttggattggatttgtgtctttgtttaaggtgatttccccctcggtgatagtggttttggtgattgagctgtcattactttgactatgcatcggcaagctatgggttatgttcggagcggtttttccttcaaccaacaccgcattttctgctcctttaccgtaagtgcctgagattgaaacacttgttgccttatgacttgatttatttcgaatgtcattaaaagtaaggcgattggttcgcagttcactgttgtttggggtagttgaagcaatggtgccgcctttcaagtggacgttgtttacctctatatgataaccgcctttgcctgcaattaaacctgcctgttcattaacttgtttataactgcttttgcctttctcacctgaagcaaaaccactcacactccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatgttcccttgactgttaaacttaatatgttctgcatctaaatgactgttatggtaagtggaactttcatacctacttccacaccaatgttctgtcctcagatttccatttactcccctttggatttattttttatccttactctttcctcccatatgtctagaggaacgaaatattcattctcagcctcttcttttgtgagatcacttattcctttcatatacaaaccaacccaataatcttcctttggtatagctgtgaagccatcttctgaaaaatcatttatcacgatttttgctaatattgatttttctccccattctgtcatttgaggagaactttcaaaagaaatatcaaatataatcaatccttaatctacttaaattcattatcaaaagttacttcataattagaatgaaattgatgaattctactttcagaatctaaagcgtaatgacttttaccctattgtatagaacgtcctaatagtaaggttgaaccactattataataatattcactatcatcaattagaattgcttccatttttaaatactttctctttagatgaataatttccacttccccaaaaaaaaccatatattactatatggtagtcttttctatttgcagaataaaagcactctccaaccccatcaatatcaaaggaaaacattttacaataagattcactatttgaaataggggtaaaaacactactaatctcatctaatctagatgggatatatccattttcatatatatataactcgatcctattaactatatcatttaatcttttttccataagaaaccattcaaactttaataaaaataaaaaaacaaacaataataaaataaatttgataaacttcactatttatcctcctttgtaaaaaatggttttgttgttttattcttaattccagagtgactgccattatctatattaggtaaagtattataattaggtgcattcttaggattagtcgcacctaatttctttaaatagttagaaacttgctttcctagacttaaatttgatttaggatcgaaatatttagctccaaattcggctccataacgatctgatggtaaatcttcatatgaataggcagaatgttttgcaggaggatataaagaatctaatctttcttgccaatatccatgcttaatagcattaagcatcgctctattttctaaatttccatctgagcaataactatttaaaatacaaggaaaatgtctatttatactctctgctatctttattaaattaactttttctgaataagcatcaccggcataaaaaacaaaatgaaccatatctatccaacctgcattctttgtataaatatatctatcagatatactattaaacggtgctgtcgttgcaggtttcagattccatgtaagatcatttaatctaaagagagcatcttctgcttactcattttttaataatcccattttagtagatgtattattaaaaaattcctcgaatccttctactgtcccggcttgagccttattaaccgcattattctccaccgcactttttccaatctctcctcccaatgtcgcattttgtatggttagacagtatgtatattaatagtatttagtagtataaaaatcaatttttccctttagtaaagcttcttttcttccaatccagcacagaaagcaatattttcattatatagcctttttcatatttaaaatttaattcatctccatccttctccaaaaatatataatcgttatctttgctaaataaaaaataaacaaatatagaattatcctccatttcaggactagaaatagataataactttctctgtttagatgaaatgttatcgacaagattaatattatcagtttgagtcatggaacctaaaatatcatcagtaatatttgccaatgtaaatctaagctctgatgtatataactcattaataactgaattaccttctatatatatattgaaaataccattaatccaaaagtagtcatcattccattcagatacaatgtcgcactgtattgcaaatttataaggatctccaaaaaacataattactcctatttaaactttaaatctttgggtataggtaaaggattatcaggatctcccgaactactagaccaatgatattccccattcgtaccaaagaatctatgaatatttccctgagagtctttcgcatatctaatagttttattagcttcaatcttatattctactgaatttttaaataaatctagtgaatctctcggttctattcctgcattttttctatttcccatcatgccttttgtatgtttaggattagatttatattttacagatattccatcttcaaaatttacattgacaggaacaggaactggtataggggaagatgtcctagtagtatttttcttcgcaaaattattctgcgtattagaattacctaaactattttcttttccaaaaagacgagaagcatttactgctaactcaatacctttttctatccctgtctgcttctcttttatcgcttgaatagtcttctggttttcactttcaaccaactgatagaacttactctgttcttcaaatggcaatccttgaatccaattattcaatgctcctgataaatcatcggcaaaaccaaccgctcccaataattcattcggtactgttgctctgcaatcaatctcacaattagccactaattcagcacgttgtttttcacttaactctttaaatctctgatgaacttcctcaacactctcaccattttgaatcgccgcttttaatgctttttgatattgataaacatctttaatagaaagggcgttaaactccaccgcactttttccaatctctccacctaatgctgcattttgtacggtatttaccgtgttgttcgattgattgtctgtctgcgaaataacaccgcctgcaaccgctcctgcgattgaagctaaagcgataatatgttgccgttcttctgccgtcagttggctagcttcggttttattgtatagtaatttcgccaaggttggtgcagcaagttctgctgttgccgccgaaaccgcacctgccgtagcattgccttttaacgctgtcgcttcaatggctccccataaagcgtgggctaacgtgttgctcagaacatcaacattaccttgttcatccatcgttgcctgtttaattaactcattcactttcgggcttaaactttgtgtcgctatcgcccctgcactttgatttgctaatatcccggttactatagtggtcaatacgttggctgttcggttatatgtgccattgttatcccattgtttttgggattgtgtcgctttaataagtgcggtcagttttgcttcgatttctgatgagcttgcattcggattcgcttgcacttgttctaaggcttttttcgcctctttcactttctgtgcagcttccgcttgtttatttgccgtgtaggtttgcactgccgaactaatatgccccactgcccgagcaatctccttttgctccacaagcagttttttcacctctttcggttttgccacttggctgtttgcttggctaaggtcggtgctaatagccaacgcttttgctgtggtttggattggatttgtgtctttgtttaaggtgatttccccctcggtgatagtggttttggtgattgagctgtcattactttgactatgcatcggcaagctatgggttatgttcggagcggtttttccttcaaccaacaccgcattttctgctccttttttgctcagtttgccggtttcactatcttggtagtaatctgctcctttaccgtaagtgcctgagattgaaacacttattgccttatgacttgattcatttcgaatgtcattaaaagtgaggcgattggtttgcagttcactgttgtttggggtagttgaagcaatggcactgcctttcaagtggacgttgtttgcctctatatgataaccgcctttgcctgcaattaaacctgcctgttcattaacttgtttataactgtttttgcctttctcacctgaagcaaaaccgctcacactccaagcattaccaaaactcacatctacactaatccctgcctgactgcctttgctgttgtaattgttgctgtcttgcttactttcaatccgaaggtcgcctttagcattcacatcaattcgctcagcagtagcggttgtgccgttgagggtaatgtcccctgggctgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcaaatataacattggccaactgtctgcttcttctatatatgcaaatttaacatcgaatgtaccatcattatttaaaacaaatctactttgagtccaatcactaccattcaccttcatttccgattttaaattttcataaagctctaatatatttcttttttcatgaggaatacaacctacagaataattgcattcatccccggcattatttatccaatacattctaaagtttgatatcgtttcatgaaattcacattcaaatatatacttatcagcttctgttggcattagcttccatatttcattagctattttaaaaaataaattgttacactttttgcaattcatactattctccagttggagtgttttttatcttaggaagttcaatgacttttccatttatagagtagttaatatcaaaagaatcaggtcttttactattccctctatatattggtttaatatcaacctccactttcttaccttgctctaaagcttgcttccattgcctttccatctgataccattttcctttcggtccattcaatatctcatccattgctacaagatttattttctctcctgcacctctaaacattgatgccagtaaatgtcctccgcaatcgctttctaaacgacattcccctccggttatggcttgtttagatttattctttatttttaaaaagtttattatttataaaagtttttaaaattagtgccaaatacaaccaaaaagacccccaaaatatatcactaaatgcatcattagcccaataaaaatcatcatatttaagataaatataaatcatgaaaaacacatgttttaacgaacaaaaagagacgataaaaaaataccaaattagccaataaaaaaaactattttttttcattaggtatctcctttttcaaaaatagaaacatcatctaagacgtcttctatagttcccttaagaacatctttatgtttcataattttgattttttcaattaactctccttgattaatattacgaaaaactctagctatatgagctatagataacaatgataccttttcaagttcaacatctccggatgataaaaaagaaaataatatttcttttgttttagaaggttcatcagtatacatacctaacgacaagattactttatgtttaatattattctcaacttcagaagaatttaatattaccattccatctttaaaattaatcttgtctaaagattcatatattaatttactcattttattttcctttatcatgagtataatcaaaaatatttatatgcattcctatttctggatcataatctaatcgctaacttttttcatttgatgatatgcgaccaataacctttccatacccatcactgatttctaaatttcatattatcttccttcacttaaagatgtttcacagcatcatgaatatttttaggtaataattgcatattattagggctactttgagcattatgatgccatgtataacattattaggataatatttgatagcaagccacttgatactcaacattactagtcttatatttttcgataagatttctacctcccaaattcagaacttgagcttcatttaacacatatgaacaacaagcaaattcatcatcatcatcaggattaatatacaaaatcgttatattttcaggtaattgaatgaatagagaatccaacagttcatccgtatcattactatatacctctatatatctctctaatttcgtcatggttctatccttctagtaggatctgcactcttagtttgctttcctgttttataattaaattcaccaaggtgttttcctttatgattatatttctctaatgtgccatgctgagaatcccattcataaatatatccttctctatctttccatctatttcgtagttttcctccaccttgtatcgaagttttacgctttacctcagttaaacctgtaattcctgtaatttcatcttttctaggtgcagggatatatttccaatcattaggattttttgcgtttttagcaaaatttgcttgtgaactagactgatttaaagcctcttctttagcaagcaaatgagctacaccaagggctaattcagcccctttttctaaagcactttgttgagctttcaagacttcaatagttttcgtattttcttcttcaactaattgatagaatttactctgttcttcaaaaggcaatccttgaatccagctattcaatgctcccgataattcatctgcaagaccaacagctttcaataattcatttggtactgttactctacattcaatctcacaattagcgaacaattccgctcgttgtttttcacttaactccctgaatttcttatgaacttcatcaacactttcaccattttgaatagctgcttttaatgctttttgatattgataaacatctttaagagaaagggcgttaaactccactgcactttccccaatctctccacccaatgctgcattttgcaatgtatttgctgtagtgttcgattgtttgtttgcctgtgaagtaacaccacctgcaaccgcccctgcaattgaacttaaagtgataatatgttgccgttcttctgctgtcaattggctcacttcggttttgttgtacagcaatttagccaatcttggagctgccagctctgctgttgctgctgaaactgcacctgctgcggcattgccatctgcaactgttgcttcaattgctccccaagtggcgtgagccaagatattaagtggcagattaacatcaccattttcatcggttgttgcctgttttatcaggttattaaccgttggaccggcaagttttgtccctatcgcccccgcactttgattcgctaatacaccggttaaaacagtggtcaataccttggctgttttgttgtatgtgccattgttatcccattgcttttgggattgtgtcgctttaataagtgcggtcagttttgcttcaatttctgatgaacttgcattcggattcccttgcacttgttctaaggatttttctgccaagtaagaataggctttatttaatattaaatttatttgatattattttttttatacataatcctataaataaaggaattgcaaaagataaaatatcacttaaagcatcttcagcccaataaaaatcaccaaatttccaatagatatatataaatatccctatatgctttaatgccgcagcagaaaatactgccaaaaataatgcaattaaataaattatcgtcttgatcattttgacaactccttgttattaaggtatttctttactttttcataatcttttactctattatcaaaatctcctccatactctccaaaagcaccgccaagaatatttccaaaggtagaatctttaaggctaaatggcttatttattataggagaaactattgcactgaaataatcgctgcctaaggtatttccactaggatcttttgataagctggttactgttgcaatacctatattaatcctaatttgattacccaatgatcgatttctggttaaagcacctcctgaaaatgcacctaacgcatcataaggattaatatcttgccctgtaactgttttatatcctacatgagctccaagcgaaatacctccatcaatcaacattccagtggtgttaggatatttagtcgaaaattctcctattacacttgcagttgtttttgccgcagatgaagctcctttagctattttaccaacgtattggacaccttttacagccgcactatgtgctcctgttcccacaaatgaaagccctgttgcaagagagttgctcaaacgtccttcaaaactttccgaatagctatatactctttgagctcttaattttaaatcagaataatccggttttatttgtggtgaatctattggtgtattcaataatctcatttgagctggtacatcgctatattcctttacccacttaaacaggatttctctatctttttgagtaagggtatcaggactggtttggtaggtatgtaataacttgtctgaaacctgatctttctttaataaatattggattagtattgcttcttcaggagttaatatttttttctctactaatctatttaatttagcatattcatgctgtgataagaaattatttttcaccgcactttttgctgtctctgctcctaatatcgttgatgaagtattgccacccgttacattgctgacaatcaaaccacttagctgtgaagccactttgaggagtgtccgttcttcattgtttaattgctctgccgatttattgaaaaccacatccgagaggaacattgccgtagtctcacctgccacaccggcagtcgctccgacaagggcatttgtacctgatagatgtgcttcagtagcagaaagtaaagcgtgagctaacaaattagccattttattgtcttttgtcattgtgtgaatttgtgcattcagctccggagaaatcgcagcagcgacaacttgcccagcagtgccaccacttaaaattgcccctaccgtagcaacgacagcatcaagtttacgtctttttgaaccgccctcttgccattccacatcttgtgtttcttttgccttgttattggcataaacattggctgcttgactaatataccccactgcccgagcaatctccttttgctccgccagtagttttttcacctcttttggttttgccacttggctgtttgcttggctaaggtcggtattaatccccaacgcttttgctgtggttttgattgggtttgtgtctttgtttaaggtgattttcccttccgtaagcgtcgctttggtgattgagctgtcattactttgactatgcatcggtaagctcggggttatgttcggagcggttttgccgtaagtgcctgagattgaaacacttgttgccttatgacttgattcatttcgaatgtcattaaaagtgaggcgattggttcgtagttcactgttgtttggggtagttgaagcaatggtaccgcctttcaagtggatgttgtttgcttctatatgataaccgcctttgcctgcaattaaacctgcctgttcattaacttgtttataactgcttttacctttctcacccgaagcaaaaccgctcacgctccaagcattaccaaaactcacatctacactaatccctgcctgactgcctcggctccgataactgcgactgtcttgcaatctttcgccgttttctccccgtccggtaaagtccgtttgtgtcgcctgaatatcaccgcttcttgccctaatctcaatctgtttggcgttgacggtgttgctacttgtatctaatacaagcggtaaatttaccgatagagtttgcaaaagtttaatcaaaacaaacactttgctgaatatatcctataaaccaaaatttgaaatcaaatcagaatcaaatattaattcttttgtatcgtatatgtatattaaattaggagggtagcgatccccaataattaacatataacgatcttctatataatcatattcatgtataaatgctaagctatcatctatatctaaaggaaaaacatacatttcttttgctgttggttttaaacctgataaacaacaatgtaagctctctggtaatttgccgttttctttctcatatttttcaataatatctttaagaactaatgctcttccgagtaaagcctcatgataattattggaatttattttgtaaaaaatagctatattcaatagtatcattactaaaaaaataattttaaaccatcgtttatttatcattatttttctccctgtttttttatgaaaattggcgacgttgaatagttaaatgttccggaatgttttccttgttcttgttctggtaaagtattatagttaggtgcgttacttggcaaggttgcctttaatctatttgttagataactgttaacctgttcacctaaagaatatccataatgattttcatatatatgagcataaaaactaatacttgatgcttctgtaggaaagaaactccatattttttgacctatagcttgatagattttttgaatttccattatttactctcttgttggtgtatttctataaatttcatttattttatttcctccattgactttataggaaatttagcataaatctcttctttcctattcactctgtccctccaaatttctaaaggaatataatattccttagtttcttcttcagttagatcacttattcctttcatatataacatattccaactatcttcctttggtatataagcaaattgaatattgaattctcctgactcagtaagtgtaaattgacaatgagaccaaaaatttccatctaatttcattaagttatttaaatctctaaataaaaaaattaattttgtagcgatttcatctggaaaatcattcatactatattctttttttatagactttgatgtaatccaaaaaagcttacaactttctgtattaggaaatatctcacactgaacaacatattctttggcttcaatagacattattgaccaaataaccttagctatttcaatatattttctctcatataaagcaacattcattaaactattctcccgtagcagtattttttaaatttcttctatttatactattatcaatagagaacttaatttcaaaactatcaggtcttttactattccctctatatattggtttaatatcaatctccactttcttaccttgctctaaagcttgcttccattgcctttccatctgataccattttcctttcggtccattcaatatctcatccattgctacaagatttattttctctcctgcacctccaaacattgatgccagtaaatgtcctccgcaatcgctttctaaacgacattcccctccggttatggcttgttgatatctatttctgtcatttacctctaattttaaacgaccttttacctcttctacccttcctaatgcgtccgttttatactcatgcccattactcagcttataaatagtattcggctccggcttatttaaatgtttattccattgtcctactctacctacatctatttctctgacatcatagccatctacttttttaatgactttcttatcaagaaattcacctattttcttagccgcatctcctctattcgccgtattaaattctgtaccaacaaccaaatctatagtagctaaagcatcatcccacgtcagctctccatcagctaaggttaaaagattatctgctatatctaacccttcttcttttaatgtcgcttttaaatcatctacacttaatctgccgttttttactcgctttttcgctgctttaataataacctttgttcctgccacaaaggctttggcaaaattattttcaaccgcactttgagtaacttcactatctacactcaaattggataatgcggaagataatgtttcacctgacaccccattgcttaaaccactcgctatcgctgatgtgatttcactaattttaattatctcctgtttctcattttcagaaagctctctcgggtctttgtgataaagtgcagtcgccaaataatgtgctgtcacctctccaacaccaaccgcaatcgcccctgaaactgcatttccccctttaaggtgagattcaatcgcaccccaaagtatatgcgttggaatatttaattcaggtatgtcttttgtcgcttctttaatcgcttgattgatataaggcgataaacctcctgatactatcgcttccgtaggcttgcccgcaacagctaatgtgacaattgctgtaatgaaatcagcagcttgtttgtatttgcctcctgtatcccaattttcactctgttcaacggcttcacgatatatttttccgactcgttcaatttcttccgctttcccctctttttttgctttttcaaatactgccttcgctttattttcttcccgtttagcctcttctgctaaatttgatgtaaaaatatcaatggcactcaccatataccccactgcccgagcaatctccttttgctccacaagcagttttttcacctcttttggttttgccacttggctgtttgcttggctaaggtcggtattaatccccaacgcttttgctgtggtttggattgggtttgtgtctttgtttaaggtgattttcccttccgtaagcgtcgctttggtaacggaactgtcactgccttggctgtgcatcggcaagctcggcgttatgttcggagcggtttttccttcaaccaacaccgcattttctgctccttttttgctcagtttgccggtttcactatcttggtagtaatctgctcctttaccgtaagtgcctgagattgaaacacttgttgccttatgacttgattcatttcgaatgtcattaaaagtgaggcgattggtttgcagttcactgttgtttggggtagttgaagcaatggcactgcctttcaagtggacgttgtttgcctctatatgataaccgcctttgcctgcaattaaacctgcctgttcattaacttgtttataactgtttttgcccttctcacccgaagcaaaaccactcacactccaagcattaccaaaactcacatctacactaatccctgcctgactgcctttgctgttgtaattgttgctgtcttgcttgctttcaatccgaaggtcgcctttagcattcacatcaattcgctcagcagtagcggttgtgccgttgagggtaatgtccccttggctgttaaacttaatatgttctgcatctaaatgactgttatggtaagtggaactttctccgttggctttttgactaccgccaccgacagtagcataaacccctacacccgtttgagctcctgcttgagcaaacatacctacttccacacccacattttgcccacgggatttttccttggttcgactttcgcctgcttctatttctatcttgtttgcatttagctcaatccgactgttttcaaggcggttgccgtctttgtcttttgacacaatatcagcatgctcaaggcggatattacctgtaccgctttggttgtgatttgccattgattcagttgataaagtgcggtcggttttgttactgttttgtgcgttgctttctgtgttatcacctcgagctgttagcaccacttctttgccatttaacacattcccttgactgagatgagcttcactttcctgtaattggcgactgtgagcgacacctgtgccactttctactcgtatcaaataaccggtattcggcgttttattggcaattttataaatgctgtcggctaatgtataaccctgagccgccaaacctaaggcttgtgcagtctgaagccttgtagaggcctctttgttttttaccacccgttcaactgtttggataatatcaataatcggcgatttgatgcgattaaattgtccgattttcaaatcactttgactttgttgttgtgtttgctcattatgagctgccaccgcttcaatattctctgcggtaatatgcagtttgtttttcgacagtatttgacttgaggtttgatgataatccttgcctgcattgatttccacattaccattaagactgacaacttgactgccttgatgacggagactatcaccagcttgattaaaccgctcacgatgataaccaaagaaacgctctgtttctgatgtcgccacctcaccaatggcgtgattttttctcgcttggcgttgagtttgtgtggtagtcgccgtcgtaaaaagaatatcacctgccgcactgaagctgttatcgccttcacttaccaacactaaacctttacctatgatgtcgccctgttgagcagtggtttggctatttccgcccacggaaatcaccgtgcctttttcctcaatcaacgattgcttgccgttttcacgccctttgccaacacctgctatatatttatttaacccgttaacctcaaatcccttattggaactgttcgccgattggctataacggttgatggctacatcaaaatgaacatcgccggttgccgtaaaggtcgcatctttttccacagataaagttgcaccttgggtgatgatatcgccaccgatagcgactaccgttaaattgccttgcgtgtctatgtttgcactttgagcaatcacctgttcagtttgtttgttggattgatgactttggtgcttgatgtaaggctgaatacctcgcattatcataccgctagtatccgtaatagcctctgctcgtgaaagctcatcaccaacaaatccatttgcaacaccttgctcttgacgttgtttgtatttttcttttcctacttcaatcgggttgtacaccatattcacaccaaccccaccggatttgctgacatagcgactttgcccaaggtgatgctcatccaccgcattgatatttaccttactaccttgaagatgcgtatcgctaccactatggatttcagtagcattcaaggttaattgatgttgagccgttactcggatattgccttttgcattcagttgtgttgcaaccacatcctcattgcgacttcgattatttgattcagttttattgcgttgatagcccaccgatacaacaccattcgaaagactaccactcaaaccgctttttttggctttctccctatagtccgtcatttttgtattgatgagtacattcaaatcaatgtcttttgcagtaatatcaatatgttgtttcgcatttatatcggtagcttcggtttttaatttatcacctgccacaagtacaatactgtcaccgtttaacaagctaccctgatagttatcttgctgttcgttatagtgcgtttctttacttttcttagaaatagcattaccgcttttatagcgatgctgttcctcaagtgttgatactgtttttattgccccaaataccatctcatttgttgcaagtgcggtcagttttttcgctgtttcaatcgccgtactttgcgtgtaaagattatcggtttctaggcggatattgccgttgctttgtatccggctaataatgaggttttgattggtttcttgacggcggtggtcgcctgtccctagtttttcactgtgttgggtagaaagtgcggtgctttttaggctgtttttaatattaagcaggctgtcacctgtgccactgttaataatatcactgccgatttggttaagattgtcggcgttgatatataatgtgccgtcttcgcctttcacgtggagtaatgccttacggtcaaggtgcatgtttttataatggtacccataacttggattgctactttcatcggttttcgtggttgagcggtgtgaaaatgtgccacttacattcaaggctaatctgctttgtgcttcaatgtgtccgccttcattagttaaatcccctgatgtctgaacataaagtcgttgggcggataaggtaccttgattatgcaagctatcgccatttaactgcatcacttcccgtccgaaaatcctgccttggttaatcagttcgctgttttttgcataaatgttattcgctgaaatcaggctgccttttgtggttaatggtgaaaaatctgctttgttcgctacaagatagactttcggtaccaatacttcttgttgacttccattaggtagtgtcactgtttcagtttccagccacacaatatcggaagtcaaccttgccatttgtgctttactcagtttcacgccaggtcggagggtaaattcatttgctagagtttggctgaatttaactgccgaatccattaaggcttgatattgcacttcaaaatcttgctgatgccctgaagggagtttaccggttaattgataaagttgttctcgcacaaggcgttgttcatagtagccgtcgcctaaacgtttttgtacttgatttgagtcataacgaagagcattaaacatataatcactacttaaccatttacgataatcggtaaaggctggggtggtttccactaaaatatgactgtccgcttgcggattgatttgataaagagaagaactcggtagtattgttgtcccttgtgtaaaacgaatttcacccttgccgtctgttattttaataaatggagctgtagtttgagaattgctttgtgctgtcgtagcaacggcataatccccttgagtttgactaaataccacatttaatggaatagtcacattatccacggtatggcggtcatgtcgtcctccccatttgcgttggaaatagcgtttgaaccctcctcgccattttgaccaagtaaattcgtgattaccgaattcttccgtagaatgaatgccttcttcatcagtgtttttaaacggactattttcatcttgacttactaaatttccaccggacagtattagcgaacggtcattatgcaccgcaccttgaaaccacatatcgccaccagccaatattttacccggtgcggtttgtttcaccaccgtttggctgattttgcgacggttgaggttaatgtcccaaaagcgatcatagattttgttggaaaaggcggcgttgtgcttttcaattgccttttctaattgctcaaattgtgtctcattggctttcaaccaatctaaataaggtttcagttgcaatgaaagtgcggtctgttttgcctgatattctaacttgtttacctcataatccgctttttcggtttcatagctttgtagacgtttagcaaaatccgcttctgactcattattttctcgagtgggtttttcgggttcattgggaatgtcaaaataggcttgtaacagatttacatcaggataatctttgagggtcaaatgtactttttcatctaaatgaatattaaaatgtgaccaagccccgtcattaggtagatacaaagaatgtggtttaatttgacaatttttcttaccggtaagattgctgcaactttcttcattcggcatcggtaagacataaccgttaaagttgccattggattctctctcttttaactcagttgctctagatgctactttaccggctcgactaaaagatatccaacgcaaggtgttaaaatcaattttggcagaattaggttgtccttcgggtaataaataatgttcatttaattgggtatcactttgtaattcaaacgctgtttttaaatgttcgttactattgattaaggatttcactccaaaataagcattgccggccacatcaattaacccactttgatttttaaaattatcggcaaaagatgagttttcagaagataactcgacttcctcagttgaattcaaacggcgaccgacaaacaaatccccctgactcaacagacttggaccttccgtgatttgaccgttttgcttttccgctatggtcaaaaattgtttttggtttatcagttcaggtgctgccaaatccaatcgtttatgagcggcaatgacggcggatttaacatcgttattattgcttgatagttgctcgtctcgattgacaatacgagcaccggcttcaatgacgactttatcgcctaatatttgtcccgtgccaatattttccaccgtctctgttgctttgataactgtcttttccgttcctaataccgcacctcggttaatcagagatttttcactttcaatccgattttgtcttcctcgaatcacaccgctcgaagtctgttcgatattctcttttgcttttacctcaaccctctcttctgcatacagcttgcctgcattatctaaagtgcggtcggttttaagacggttttttgtcgctgctattatttgaccggatgcggtattcacaatcttgccctgactatcaatcactatctctgagctacttgcaccaatatgccctgcattgcgtaccccaacgccgttttctgtaccgataagataaattttgcccgaatacattccgccaagctctgctacatcaagggaaaattgcggttgtgactcgcctgaaacgtgttgggttgtgtgaataatttgcaaagttttgtcggaatcaaaccgcttgatactatttttccctgtgataacggttgcttcttttttcgaccaaatccctgcattcacttccgcttctcgagcgaggatttcagtataatccacacgactgttgtccaagcctttgccgctgacattgattttaccggcttcaaccttaaaactctccacttccccgtttttaatctcaggcttgcctgtagaaagtgtcactcgaccggaatttatcacaccgcaaccttcacaatgtagcccggaggggttggctataatcacatccgctttgccgcctgctacttccacatagcctttcatcacggacggcgaagaagaattgatctcgtttaaaatcactttcgcctcaccttgggcgagataaggattagccgtcacctgccctgcaagttgggtagaagtgcttgtgcgactgttatttaaaattactcctttctcggcaacatcaaattgtgaatatttattatgggaaagccctttggtattgggcgtttgaatattgacttgcggaagcccattggtagtttgtaaaacaatcggttgttgggtttttggggcggatttatccgcttgaataattaaagtttcagcaaaagcagaagagaaaaacgaagaaaaagaaacaaactccaaggcacaaaacaaactgaaataaagaggttttaacagagctaaaagcgaagaaaaatcgaccgcactttttgaacaaacagaagacgaacatgaagatttgtcttgggattttgcaagttctgatacaacgattaaacgttgtaaggggttactaaaaataatgcaaaaatgttgtgtgttcataataaatcctcctgatttttccgttttgattatcccaacctgccattcggcgtttttgtacttcaatttccgacttatcaatatagttttgcgattgatgtgaccaaagtgcggtggaaattgtggtttttctgtgactgtcacgataaatcaaataaaacaaaacaatgtgcgcttatcggtttcgctttcacctgaataaatatagctgttatcaaacgcccattgatggataggatagcaaggcaattcagtataagaaagcaaaagtgattcagggggagagatatttaggcgaatatcgggtttaggctgtgatttatcatcttttgcctgctgatgttgttgggctatatcgtttaattgagtatcaaatgtattagtgaaagtggtagtggatattacggaagaaattaagcttaaaatgagtgtttgatggcatttcataatatcaaatagaaaattatatagtcattctaagtagaatatagaatttatcattttttgcaaataatgttactcagtatttaggaaaagaagagtatggttgatattttgttgggatgttcggggaatattatcgggtatggtttagtaccgtttggtgatacacttacttcagccaaaagaaaaatgggagaaaattattctcctatatttatgttacggatagacaaactccgttttatcttttaaatggatggattttataccgaacacttcattccttttggagttttatgtcaatggggattggaatacatctgtcatctctgaatcaacttagcaaaatgcgatcccaccatgtattaagtaaaactattaaattacttggtttgtatgtgaaattacattacatagttttattagttggtgctgatcgctatagtttgcattatatttcaatgagattaagcagttgttgcagcttccattgagaataaacgtaatttattcattatataattcaataagataccgtaagcaggtacgaagaatagaatactaatgaaaattttaaataaataatctacagaaccgatttcgacccagtgttcagccataaacggatcgttacttgcgtagaaagcaataccaaagaatatgaacgtatccgccagtgagccgaataccatagagcaacttggtgcaatccaccaagtttttaatttacgtaaatggttaaatacatacacatctaatagttgcccaaacaggtaagccgcaaaactggcaaacgcaatacggaagacaaatgtgttaaatgatgtaagtacatgtaaaccttgatattggctatcggaaaataatgttgaaacaagatagctgatgattagtgcggggatcataacgacaaaaataatccatcttgcttctctagcaccaaaaactcgcacggttaaatctgtggctaagaaaataaaaggaaaggtgaaagctccccatgtattgtgaaacgaaaaattctccgcaaatcctaaagttgtgagaggaatggtaatttcaaaaggaatttgaacgaggtagttgcttgccgtaatgataaatatatggaagaaactcaagatgattaatgcacgttttttttgttgatcattgaagatcgaagagatgtttttcattttgtgtacctttttgataaataaaattggggttagggaacccaatataaacatgtccaaaattggagacggagaatgatactgaattaagaaaatatttcaactaatatttacaagccaaattgctatttttttgctattctacacgacaatttttatattacatttaatggatcacagtcatgagcgaaccagaaaatcttgcacaaaatcaaccgcacttttccaaagatacaacgcattttggatttcaaactgttgcaaaatcagagaaacaaaaattagttgccaatgtttttcattccgtagcggcaaaatatgatttgatgaatgatttactttctttcggcattcatcgagtttggaaacgctttactattgattgtagcggagtgagaaaggggcataaagtcctcgatcttgctggtggtacaggggatttttccgcaaagttttctcgtatcgtaggtgaaacgggaaaagtgattttggcggatattaattcttcaatgttggacgttggacgtgagaaattaagaaatcttggtatcgtgggtaatgttgattatgtgcaagccaatgcggaagaattaccttttgcagataatacgtttgactgtgtgataatcagtttcgggttgcgtaatgtaacagataaagacaaagcattacgttcaatgtttcgggtattaaaaccgggtggacggttgttagtgttagagttttctaaacctattttggatcctttaagtaagatctatcatttttattcttttaatgtattgccaaaaattggtgaaattgttgtgaatgatagtgacagctatcgttatctggcagaatctatccgtatgcacccgaaacaggacatattaaaagagatgatgataaatgccggttttgaacaagtcggttattataatttaaccgccggtattgtggctttacaccgaggctataaattttaggatagagtatgttgcctgattttaattctttgaaaacacagtttatgttaccgcagtttattaatgcgggatgtgaactgttattaaattatcttttgcgacggacaagtcatcgtgaaagatacttgcgtcaattacaaggtaagatcttaaagctgacattacaaaaaacacatttttctttgtatttcgttttttcagcacagcaagtggatttattgaaccattatgaaggtgaggcggattgtacagtggatattgcggtaaatttattattgcaaatgccgaaaaaatcggaaataagtcgatttattaatgataattcccttcaatttagcggggatttgcagatattacaagattttgtggaattaatggaaatgttggaaaaagatccggcagagctgatttctccttacgttggtgatgtgattgcacatagtgcggtcagttttcttaaaaatttaacagaatcaataaagtatcggcttacgcaaagtcagcaattttgggcggagcgtttgacagaagagtggacagtactttcgtccaaattggctgtaatggatttttgcgatcaagtggaaagtttagcaaaacagaccgcacttttagaacaaaaaattaatcagattttagcatgatgaaatttaatgatattaaacgtttatataaaatagtacgtgtttttttatcttatggcattgatgaaattttaccgcataataaatatactcgttcaattcgttgttggcgaatgttatttttttggttaaaaaataaacataacaataaagcttttggattacgtttgcgtttggctttacaagagttaggaccagtttggataaagttggggcaaatgttatcgacacgtcgtgatttatttcctgcggaaattgctgatgaattggctttattacaagataacgttgaggctttttcaggaaagattgctcgtcagcaaatagaacaagctttgggttcttctctagaaaattggtttacagattttgatgaaaatgcacttgcttccgcatctattgcacaagttcatactgcaaaacttaaattgggcgaggaacaggaaaaggaagtggtcatcaaggtgttgcgtccaaatattcagccacaaattgaggcggatttaagttggatgtataaattagccggtttactgcccaaattatttcgtgaggggtatcgtttaagagcggtcgaagttattcaagaatatgaaaaaactttgcgtgatgagcttgatttacgtgtcgaaatggcgaatgcaataaagttgcgagaaaattttcttgatagtccgatgttatatattccaaaaatgtatgaagcattttgtcataaaaatgtgattgtgatggagcgtatttacggcattcctgtttccgatgttgagacattacaacgaaacggcactgatatgaagctattggcggaaagaggtgtacaagttttttttacgcaagtatttcgtgatagtttttttcatgcagatatgcacccaggcaatatttttgtgaatccgcttcgtcctgaaaatccgcaatatattggtattgactgtggcattgtggggaaattaaatgagagtgataaacgctatttagccgaaagttttgtggcattttttaatcgtgattatcgtcgggttgcacaaatgcacgtagatgccggctggaccccacaagatacgaatattgatgatttcgaacaagcatttcgagaggtatgtgaaccgattttcgccaagcctttatctgaaatttcatttgcacaagttttactgaatttatttaatgtagcacgtgaatttaatatgcaagttcaaccgcagttagtgttattgcaaaaaacgttactttatattgaaggattagggcgtcaactttatcctcaattagatttatgggatacagcaaaaccctttttacaaaattggttgaacgagcaaataggtatgaaggcaacatttaaaaagttgaaagccaaattgccttatttgcaggagcatctacctgattttcctgaaactttaatggacgccttgaaacaacaaaaatttattagtcagcaattagtggaaattaacaagaagttagctaaacaacaacgttggcaaaagaaaatgtttgtattaattgtgggaatagtgattttttctgtaacgttatggcaattcgctgcattgccgttggcgataagtgcggggttattcttagttggttttttagtttggctaatcggttttttgttaccttaatgcgttagatcaaaaataatccagtttagctattgtcactatgatttaaaatggttatattctgcaagattttttattaagtttaatgtcataggagaaataaaatgggattaagttggcaacaattactaattttgcttttagttgttgtggttattttcggtactaaaaaattaagaaatattggttcagatcttggcggtgcggtaaaagacttcaagaaagcaatgaatgatgatcaacctaaagatgccgaatttaaaaaaatttccgaagaggtagagcaaacttcagtcgaaaattcaaaacaaaaagagcaggcgtaatctgtgtttgatattggtttctccgaacttgttttacttttcgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaagtgcaagaactgaaaagtgcggtgcaaaattcacagggtactgcaacgaccgaaatagaaaaaaatcttgattttccttccggtgagttatctcctgctgaacttgcagagttagcggaagagggagaacctatgttggaacttactgaatctgatttttcagaaaaggagccaacgactatctcgtctaatgaagtgattgaaaatagtaaagaaaaagtatgagtgtcgaaaagtctcagccattaattaaccatttattagaactgcgtgatagattattacgcagtatcatttttgtagtcgtaatatttctcgccttagtttatttcgcaaatgatatttataattttgttgcctcgcctttattagatgtattgcctgccggtgcgacaatgattgcgacgaatattgcgacacctttctttactccgattaagttaaccgcagtagttgctttgtttatttcagtgccttttttgttatatcaaatttgggcgtttgttgctcctgcattgtatcaacatgagaaacgtctagtttatcctttgctgttttccagtacgttgttgttctatctcggtgtcgcttttgcttattatgtggtatttccattggtatttgcttttttgactaagaccgcaccggaaggcgttgctatcgctacggatattagtagttatctggattttgttttagccctattcttagcctttgggatatgttttgaagtgccggtagccattgttttattatgctggagcggtgtgactacgccggatgatttaagaaaaaaaagaccttacattattgttgctgcattttttattggtatgctactaacgcctcctgatgcgatttctcaaacattgttggctttgccgatgtgtttattatttgagataggtgttatttgtgcgggtttttatcagccaaaagatgaacaggaaaaatcataaaaatgatttgaatttgagtgaataagattaaattattcgctctggtttgtagaaaggattggaaaatgactaaacaaatatttaccggatatcctcaacgccgtttacgtcgtatgcgtaagcaggattttagtcgtcgtttgatgtcggaaaataagctgacagtagatgacttgatttatcctgtgtttattattgagggagaaaatcatcgtgagtcggtgccttctatgcccaatgtggagaggttaacgctcgatcaacttttacttgaagcggaattgatggtgaaatacggtgtgcctgttattgcattgtttcctgtcattgaacaagagaaaaaatccttaatggcggaagaggcttataatcaagacggcttagttcaacgagcggtaaaagcattaaaagcaaatttccctgaattaggtgtactgactgatgtggctttagatccttatactgttcatggacaagatgggattattgatgaatatggatatgtactcaatgatgtaacttctgatgtacttataaaacaagccctttctcatgctcaagcaggggcggatattgttgcccctagcgatatgatggacggtagaattggtagaattcgtaccgcacttgaaaagcaaggctttgttaatacactcattatggcttattctgctaagtatgcctcaaattattacggaccatttcgtgatgctgtcggatctgcatcaaacttaaaagggggcgacaaaaaaacctatcaactggatcctgctaattctaatgagggattacaagaggttgctcttgatattgaagaaggtgcggatatggttatggttaaaccgggtatgccctatttggatatggtttatcgagttaaagatcaattcggcgtgccgacttttgcttatcaagtatctggcgaatacgctatgcacatggcagctattcaaaatggttggctaaaagaaaaagaatgtattatggagagtttactttgctttaaacgagcaggtgcggacggaattttaacttattttgctaaacaggtagcggaatggttgtatttagacgaaaagaataaataatttaaaatagattttactttaacccacttcgtgttagcgaagtgggttttgtttatctacaattgtatgtctaatttatcataggctcgagaaactttttctaacgccttatcaacagaaatatcacgtgcaagaataacacctaaacgacgatgcccattgacttcgcctttgccgaataagcgaatattagtattaggttcttgtaatacttcgaataaattaccaaattgtacttggttagatttgccttcaacgacaatcgcttttgaggcagcggggctaattaaattaatttcaggaattggtaatcctaatatggctcttgcatgaagtgcaaattcagaaagctcttgcgagattaacgtaaccattcctgtatcatgagggcgaggagaaacttcattgaaaataacatcatctccacagacaaacatttctacgccaaaaataccgcgtccgccgagttctgtagtaattttttcagcaatatgttgagccttggcgagtgcttgtacagacattgcttgcggttgccaagactcacgatagtcccctttttcttgacgatgtccgataggtgctagaaatgaagttccttctgcatggcgtacagttaataaagtaatctcataatcaaatttaacgaaaccttcaacgatcacacgaccggctcccgctcttcccccttgttgtgcatagtcccatgctttttgtaggtcgtctttgctttttaagatactctgaccatgtccagaagaagacataatcggtttgatcacacaaggaatgccaaggttttcgaccgcactttgaaagtcatcaaaattatctacaaattgataatttgatgttggcaactttaatttttctgctgcaaggcgacgaataccttcacggttcatcgttaattgtgtagctttagcagttggaacaacattaaagccggcttgctccaattcaactagtgttgaggttgcgattgcttcgacttccggcacgatataatccggtttttctttttcaattaatgctttcaaagcatctccatctaacattgaaatagtgtaagagcggtgtgcaacttgttgtgccggtgcattttcatagcgatctaccgcaatcacttctacaccaagacgttgtaattctataacgacttctttgcctagttcacctgaaccaagaagcatgacttttgttgctttaggtgttaaagctgttcctaatattgtcattttttgtccttttacattgtgttttttattaaaataagatttaagaattgagtaaattatcatctaaaagtagatcttcatttttattaatacctacgcctcgattaagaatattccgtgcaatattatgtgcatcttccaatgaatgttcagtataggttccacattgatattcgtttagttcaggaatttcggcttgatttttgacgtttaaaatatcttgcattgaagctgaccaagcgtttgcaacttgttgttcattcggcatgccaattaatgacatataaaatccggttcgacagcccatgggcgaaatatcaataatttcaatttgttcactatttaaatgatcacgcataaatcctgcgaataagtgttctaaagtgtgaatgcctttaggagagaggatttctttattaggaatacaaaaacgaagatcaaaaacagtgatattgtcgccttttggtgttcgcattgtttttgcaacacgcacagcaggggcattcattctcgtatgatcaactttaaaactgtcaagtagtggcataatttttcctttagagagcattaaaatagattattgaccggtattgtatttacctagaaattgtattgtaacgtattgctataacaaaaacctgattttttatgatataggtcatgatttttaatttattgtcgataattttaaattttatgtagattttctttattttattgagctttatactttttcttatcctatcaaattaattcgtcttttttttataaaaatagggtagaatagccgatcgaataattcaacataacttcgcaggagaataatcatggtaactcgtagggaattggcaaatgcaatccgttttttaagtatggatgcggtacaaaaagcaaaatctgggcatccgggagctccgatgggaatggcggatattgcggaagtattatggcgtgattttttaaatcataatccgactaatcctcaatgggcaaatcgtgatcgttttgtgttatctaacggtcatggctcaatgttaatttatagtttactgcatctcaccggttacgatctttctatcgaagatttaaaacaatttcgtcaattacattccaagactccggggcaccctgaatacggttatgcaccaggtattgaaaccacaacgggtccattaggtcaaggcattactaacgctgtaggcatggcgattgcagaaaaaacgttagccgcacaatttaatcgagcaggtcatgacattgttgatcatcatacttacgtttttctaggggatggttgcttaatggagggtatttctcatgaggcttgttcattagccggcacgttaggtctaggtaaattgattgctttttatgatgataataatatttccattgacggtcatgtagatggttggttcactgatgatacacaaaaacgctttgaggcttacggctggcatgttattcctgctgttgatggacataatgcagaacaaattattgaagcaataaaacaagctcaggctgagaaaaataaaccaactttaattatgtgtaagacgattattggctatggttctccaaataagcaaaatactcatgatagccatggggcaccattaggtgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcagttgaatttaaacgccgtttaaatggggaattaccggcaaactgggcaacagaaagccaagcctttattgaaaaattacaagcaaatccagccaatattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatatagatggtaactatattaattatggcgtgcgtgaattcggaatgtctgccatcatgaatggtattgcattgcacggcggatttattccttatggtgcaacgttcttaatgtttatggaatatgcacataatgcagtgcgtatggcagccttgatgaaacaacgttcattatttgtttatacacatgactctatcggtttaggagaagacggtccgacgcatcaacctgttgagcaaacaaccgcacttcgcttaattccaaatttagaaacatggcgtccttgcgaccaagtggaatctgcaatcgcatggaaagcagcggttgaacgtcaagacggtccaagtgcattaattttcactcgacaaaatcttgctcaaatgaaccgcacttctgagcaattggaaaacgtgaaacgtggcggttatatcttgcgtgcatgctgtgaaaaaggtgattgtccagatttaatcttgatcgccaccggttctgaagtggaattagcgatgaaagcagcggaagcgttagatgcggaaggcgtgaaagtccgtgtggtatcaatgccgagtacgaatgtatttgataaacaagatgttgcgtaccgtgaggcagtattaccaagtgcggtgactaaacgtgttgcaattgaagcgggtatttcagatttctggtacaaatatgttggtactaacggacgtatcgttggtatgaatagctttggtgaatcagcaccggcagatcaactgtttaaactctttggcttcactgttgaaaatattgtggcaaaggcaaaagagattttataatcagttaaagtttaattttgtgagcgggtaaatttacccgctctttttcagtattatgtagcagttgtacaaagcttaatttagtatttctgctacattttttcttactctcattacaatttaaaggtaagaaaaaatgaatgccttagaaaagttattatgcgatgacgcttcaagcactaaatttacaaattaaatcaccattttcggcaagttcgctacaatccgattggtttccaaacttacggtaaccacccgtaaaaatagttccatcgggtaacgtgggttttgcatggtttcgatagcccaatcattcgcatcatttacaatgccacttgctttatcgactttcaccgattgacgttcaatcacccattccaatgcaggtttgccgttaaccacatagccgtaagcctcttcggggatattttccagcgtaaattttttgttataaatcactttagttggatcatcttcatttttgcctgtttcaagattcaagcgttttgggtgtttcattttttccacataaaaatcgctatcagcaccgccaacaatcctatcatttgaaatagataaaccgcctgtaaacaatacgccgttatacatcggcacggtttcaaaatttaaatgatagtgagctaattcacgcccagcattagaaaatgcccaaaaatcgaccgcactttttactctaggaatgcgtggcaattgcttactgagattatccgcatatttttcccgataatcttcgctatgtaataacccatagatatagtagaaaatatcttctttttggatattttcttgctcgccgtaaaattcggtgaagtgttttaaggcttcatcggtgatcgccgagcgtctttggtaagtttttggcggaatttgaccgcttgtattttgttctgtcattgtttggttatcctgttttattcgtaaatccacatcggaaaacattgtccgttcgcttgtaattgaacatcgggtatctgatcggtaataatcaccgaaaagcccttgctcgttcccagtcctgttatgcaaatcgccaaattctctactcgtagatccacatcgggaagcattgtgcatcgccgatgagatgcagatcggggatctcgttgctgatgagaattgagaatcccttgttgcctgtaactgtgaggcagatgataatgttgtctgtctgtctgtctgtctgtctgtttgtctgtattttctacgctatcaaacaaatcttttgggaaaccttgaccgcccgaatgttgcatattgagatctgggattacattcgtcattacagcagaaaattcttttcctgaatttcctgaaccgcttaaatagatcatttgatttataacattgggaacaggaaataatttgggtaactgatatggacgatggttaaatgttttatcaaaataaatatgatttttagtataaggtctatacaatccttgtcttattttatctttagagaatctttctttttctcctttacttagcttaggataaagactgctagaccaacttattttagaatcatctttatcagcaaactgtacaggatcaatttctaaatttgtttttctttgaatatttaatctatctatttcattattaaaaaatgtaatagaattattcatattttcagataatctttctttagaaaaattgtaaacccaagcatcacgatttgtctgtaatccagctgaataattttcaaatatagtaggttctttattatttttatcttttgagcctaggaccatataactatcaaaattcggatctcgttgatttagccagtcattaaactgatcgggaataatttcctgccattgttctgtttttgtaattccgttaattgaaccaaattcagcgattttttctaatttttctttttttgatagaaaatcaccaatatcataaaaatgaatattgccatttttttctttatctggatttttaactaaaatagaaatagcaactcctgtcataatatcaaaaacattttgaccttcttttttagccgaaatgccagatttaccacgaatggcacctcttaaatggaaaatataaagatcgctaaattcatcgtgtaaacatttacgtaatccatttgctgcattcgtttctaaaaaaccagcattggtaatgaaaccaattactcctttatcttgaatacgatcacttgcccaacgtatcgctttaatatagctatcataaagtgcatttttatttgttgcagttgaatgtaaagcataggtatttctaattttttcttctaataatggataacttgtgttttcattattatcatttgctgatgtttgcccaactgaatacggcggattgccaataatcacttgaatatccaattccttttgacgtttacggcgttcgctgttttctaccaaaatttgatcgatgagatcttctttttcgtacatttggaaagtatcagttaaacagataccattgaaaggttggtaagcggttggattttcgttattttttgcaagtagcgagtgataaacactttcaatgttaattgccgcaatgtaataagcgagtaagacaatttcattggcgtgaatttcattatatttttgcggtaatttttcaggcggaataatcccgctttgcaataatcgggtaatgaatgttcctgttcccgtaaatgggtctaaaatttgtacacctttatcggcaaggctagcgttaaattcattttgtagcacatcttccaccgagcggataataaaatccactacttgaattggggtgtacacaatacctaatttatcttttaattttttaaatgcttgagcaaagaaattatcatataaatctttgatgatagattgtcgtccttctggacttttgatattgctaatgcgttgctgaataccctcgtagaactcttgtaactgcttggtttctgcattggcgatattttcgccttgtaaaatagtaatagtttcacttaatgctttagacattgggttgtgttcggtgaaattatcgttagcaaataaggcatcaaaaactggtttggtaattaaatgctgagctaacatttcaatcacttcatcatcactaatcgcattatttaaatcatcacgcaattctgccgcaaaggcgttgaaagcggtgatttggcgttgattgttagggttttccaaaatcgctttaatccggtctatatgagtttgagcaatttttgccacatctgccgcccattcttcccagtgcatacgatttccacattttttcacgattttggtaactaatgcacgctcaatttcgccaatttcaaactcaaattcttcttgagttggaaaatcagctcccgtgcctttacctccgatattgtgttgatttcgccccgatttttcatattttttctttttcttgttttgatcttttggctgctttttcaaaatttgcgagatggtagaaatgacttcgattttatctttggctgtaccatcaaactgcattttgttgatcattgcatcaaagcggtcatcgtgagaacgcagagcattaagcacttgccatactactttatagttttcattattatctaaggcttcttctggcgttttcccggcaggaatcactacaggcaaaatgacataacctcgctttttgccttctgttttccgcattacacgccctaccgattgcactacgtcaatttgtgagtttcttgcagttaagaataacacggcatcaagggctggtacgtccacaccttcggataaacagcggacatttgagagaatgcggcaggtgttatattccgtttccgatttcaaccagccgattttgcctgttttttcactagcattcattgagccgtctacgtgttccgcttcacattttagttgtagcgattggttgagatcataaggtaagccctgttcttccaatgatgcaatttcttgttcttgataggtttcaactaccgtcgagaacatctctgcaatcgctttggaactcactttgtgtttattacctctgtaatttttctcaatcacttggcaaaatgctaccgcacgtttcatgggctgataatcatcggcaagatcttcttccacaccatattttgataatgctttccaacagccaacgatttttgccgcatcgtccacttggatttcattaccttctgcattcaaaagattctgcaaacggcggttaatatgagcctcttcaacggcaagtactaatactttataatcgactaataagccttttttcactgcggtagaaaagctgattgtaaatagctcttcgccaaaaagtgttttatcgtccattgaataaacttccaccccttcagattttttggcatcttcggtatagatgcgtggggtggcagtcatataaagacgtttttttgcttggatataatcattattgtgaatgcgaacaaatgccgattctcgttcatcgtcaaaggtatgtcctgtagtgcggtgggcttcatcacaaatgataagatcaaaactatttaagcctaatttttgagcctgatggataacatcaattgagtggtaggtagaaaagatcacggtcattgcttcattggcatttttgcattttataccccgaattaaaccgcttgcatcggttgtggcagggtaggaaagctcgtgtaatttagtttgaactaaatcatcgttagattgtttgccgacatcactatcggaacagaccgcaaagctgtgcagttttacactgctttcttgtgtccattcagttaaagtttgagaaagtagtgcaagacttggtacgagaaacagtacgcttttcccttgtccagccattgcttcggcaattttgagtgaagaaaaggttttaccagtaccgcaagccataattagcttaccacgatcggcagtttctaaacctcttttaactgcttttagtgcttgaatttggtgttctcttaattcctttttagcacgcaatacaaccggttgttttggcacatatttttgccaatcgatcacactttcttcaaaattggaacggttgataatattgactggaataagttgatcagcaagggatttttctgcattttcagaccaatggtttgtcgtggtaacaattaaacgatgtgtaaaatcttttttacccgatgcagtgaaaaagctatcaatatcgcttttttgaatgcggtaatcggcagaatagtttttgcattgaatagcggtaaatgtgctatcaaaaccaacagcgactaagtcgatacctgtatcatttttatttgtgccttccggttgatatttttctacccaatcagcaaaggtgagaatttcttgatagagattcgcatattgcggttcgttggtgagatagtgttgagttaaggtttcaaaataagtgcctttttcacgctgggtttgcgaattttcttgcaggcagattaaaagttgagaaaatgctgattgattgattgattgattgattgattgattgattgattgattgattgattgattgattgattgattgattgattgattgattgattgattgattgattagacatcatattttccttttatcattgtatcaacacgctgaatttgatctgataaagaatagcaggttagtttaagttgagctagtaagagcgggtaaatttacccgcttttttttgctttttggttaagtgaagaataaaaactcaaatagaataatcgctattttgtcttaatagcattgagttagatccccctttaatgtaaactattgtcccgtctttatgggaagttgtttgttgtcaaagcaaattctccaacacttattttcatatcaaaaacacataggtttaatatggctaccaattatatttttgtaaccggcggcgttgtatcttctttgggaaaaggaattgcagcggcatctttagctgcgattttagaagctcgtggcttaaatgtaactattatgaaactcgatccttatattaatgtagatccggggacaatgagtccgacacaacatggtgaagtttttgtgactcaagatggtgctgaaacagatcttgatttagggcattatgagcgttttattcgtactaaaatgacgaaacgtaataactttacggcaggaaaaatttattcagaagttttgcggaaagaacgtcgtggtgattatttgggggcaactattcaagttattccgcatattactaatgaaattaaatctcgtgtcattgatggtgcggcgggatatgatgttgccattgttgaagtgggtggaactgttggtgacattgaatcgttgccatttttagaggcattacgccagttagccgtccaagttgggcgtgaacggactatttttatgcatctaactttggtaccttatattccaactgccggagaggtaaaaaccaaaccgacacaacactccgttaaagagttactctcaattggtattcagcctgatgtattaatttgtcgttcagatcgtatgattccacccaatgagcgtgcgaaaattgcccttttctgcaatgtaccggaaagagcggttatttctttaaaagatgtatcatctatttatcaaattccggctttattaaaatcacaaggtttagatgatttcatttgccaacgtttccgtcttgattgtcaagaagcggatttatctgaatgggaaaaagtgctttatcaagaagcaaatccgacaggtgaagtcactattggtatggttggtaaatatacagaattacctgatgcttataaatctgttaatgaagccttgaaacatgcgggattgactaatcgtttaacagtcaatattaaatacattgattcgcaagatgtcgaaacgaaaggcatagatattttaaaagatttggatggtattttaattcctggtggctttggctatcgtggtgtagagggcaaaatcttaacagcacaatatgctcgtgaaaacaacgtaccttatttaggaatctgtttaggtatgcaagtggcgtttattgaatatgcacgtcatgttgccggactaaaaggtgcaaattcttccgaatttgaccgcacttgtgaatatccagtcattgcgttaattactgaatggcaagatgcagaaggtaatgtggaagtgcgttctgatgaaagcgatttaggtgggacaatgcggttaggtgcacagcaatgtcatttagtcgcaggaagtttagcacatcaattatacggttcggatattattgaggagcgtcatcgtcatcgttatgaagtgaacaatgttattcgtccgcaagttgagaaagcaggactgaaagtaacaggcttaagtgcggataaaaaattggtagaaattatcgaagtaccaaatcatccttggtttgttgcttgtcaatttcatccggagtttacttcaacacctcgtgatggacatccgctatttgcaggctttgtaaaagccgcaagcgaaaaccggaaaaaataaacgtgcagaaaataaaaatagcttgggaaatccaagctatttttttcttattgatatagttccgacacaagttgaggagagagcaatctttctttttcatggaatagggttcccatgtagtaagacccgaacggagtaaaatgatcttgatcgccataaatagatttatttcctacataaactgtatcacctaaatattttgccgcatcaacccatgtaacattcggaatgtttttaattaattggaagatttcattgttgcttacggtattgtccgccaatttttggatcggatttaaatatttatctaagtcatattttgctaagaatgcatttctaagagcggaacgatttaacgagatattattcgcaaacacatagactttttttatttttgccagatgtttaaccatcgcttgaaatttttgatcaaaatcagcaattacaaaggaattaggattgaatctcggtacaggtgtaccgcctctttttaactcataaaacatggaaataaaaatgacaggataagattcaattttttgccaatattgtgcacaatctttatcctcaaatgagaggcaatcacgaatgtttaaaatatccgaacgccacccttcttttgaaccgacataatttaaaaaatcttctagatgccctgcatgcgaatcacctatggttaaaattttacttggaatattgagaggcaatacttcttgttccgctttctgagcttgtaaagcagaagttttatgctttatatgagaacgtacacttaaattgtagccgatgacaactaatgatgggattaaatataataggaaaaaagactgtttaaaggttaatttagattttctaataggttgttccaataaataataacttaatgccgaacaaataaaagtgagtacgatgattgttgacatcctcccccgcctaaaggcaggggattcctactagctcccacagcaagctgtgggctactctcggtgggtttctactgctgatctctattgagattcacttcatagacgcttcgggtatgtcctaccctgatatttattatgcttggactattgcttgcccacgtgtgagaacattcattgctcccactacatcggcattttctgtatagccacattctacacatttaaaatgagcttgagtttcacggttttcttttgcaatatgcccacaacaagggcaagttcgactagtattctgtgctggaacagcaactaaaaatccgccaagccattgcgttttatagcccagttgtcgtctgaactcaaaccaagactgatctaatatcgcacggtttaaacctgatttctgtttcacgtttttaccgtgttcttccgctgtgccttttgccgatttggacatattcgcaacttgcaaatcttcaacatagatcattgcgtggtttttgctgatttgggttgagattttatgcaaaaaatcttttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggtctaatttcaaacttaaaggctttacggagtaacattgcacaaattagaatacaaagattgttattattctacacttggtctatgaaaaaagaaacagagattagacgtggtcgccacgttgtttttaacttacacgttcatttagttttcgtgactaaatatcgcagagaagtttttactaaatttattcttgatgacttaaaagcgatttttgaatccgtctgttcggattttgaagcaaaattagtagaatttgatggcgaagacgatcacgttcatttacttgttgaatatccaccgaaagtagctatatcaaatcttgtgaacagtttaaaaggcgtttcaagcagaatgattagaaagaaaaactatccgagtattcgcaaaaaattatggggaaatcagctttggtctccgtcttattttgcaagtagttgcggtggtgcacctatatctattattcgccaatacattgagcaacaacaaacacctgattagttaggtttgaaacggctacgccgtttgtgccttatatccccgacctaaaggacggggctttacggcactgtctggtaaaaaattgtccgcactttgtaaagtgatctaaatcacatttttttaaaatcattgaaataatcctgttatttgattaattttggtctgtagtgattgctgttaggctctttctcgtactcataaacggcaatggggcttttgtgaattgtgatagattgatatttatcaaaatctaatcctatcttacgcaatcctttgaatatttgccctttgtgcgtaaactccgaaatattttcattgttgccgtctatggttttgcctgttaccacataaaaagcctttattctgcgttttggtttttgcatttaatcaggctcgctaattaattgataaagtgcaattccgccatgtggttgccctgtatggtctatgctattaattcttgtggtttcgatttgatagcctttctcacgtaactctttaattctctgtgcgggcgaggcaatccccatctgcctaaaatcaaaagtacttgagctacgctctctcaatacctttaaaatagttctgcactgtgtcgcttttgaattgtcttttagaactcctaccatgcttcccccttaacttgcgatatagctttcaatatcagctaaccgccaacgagtagaacgcccgcacttcttcgcctttggaaactcgcccttattcattagcttgtaaattgtggtagtagaaaagcctgtaattgctttcacatcttcaatattaattagtttcttttggtaaggttgaacagattgagcttgttcaatagtttggatagtttcgctttgtgttgtcataatttcccctttaggtttggtgttgtttgtatgtggggaattgtgttggaaaataacttttatttcatcttattgatttttaaattaaaaactcgttttcaaataaggcttaattgaaaagaaaatccccttatttgaaaactaaaagggcttaattaaaaagattatttttgtttagaggggaatttagaggggaatatagacaatccatttattcttaaattgtcatctattaaattgtctaaggttggatattttatatcgctagttctaattccatgctctttcatatccgcatttattgcgtcaaataatgcgtttctgctttgatagtcttgatagttttttaacactagtagggaaaaaagatcgcgttgcggttggctaattcgtccttgctttggttgggttaaaacatcatcagatttaaccgcactttctgcccttttagcttgttctagctgtttttcaagctcggctatttgttcatctttcgcttgaatggttgaatttgcttgttcaagttcggcaatgtgggcatgtagttcggctatttgttgcaacatcactaatctttcagctaagcccacggggcttttatttatatctgtatttcttacaaattcttcagttcttgtaagtgccattcctaccgctagttttatctcattttgatatttattatttaaagcctctttatcaagagtgcttattcctaagatattttctatctgttttcggtcaatgaaaatattattttggtaatctgtcaaataatcttttgcggtgcaagtgtcatcaaaaattagtgcttgtttatcagttttaatctcttctaaagcagaaaaaaattcactaccgcaaatactctgaggtttgttactaatatcttctgttataatgtatgtttttattccatgctctgactcccaatattcaaatgcttcatccccccacaattgatcatctgtttttctaatatcgtgcggttcaagttttatcaataatagggttgcaatctcactataaaatgcttgaggattgtgtttctttataaattctagaagttcagaaatggaaataaaatcttgctctctctgctttcttattgctataagctcgcttgtaacatcaaacatcttaaacgcccctattcgttaccctatctagtgagggtgcaacaaggaatagatagggctattccctttcggctcggttaattactcctagcctagttgcaccaatttgaaaattcatgcttggttgttatatataaaacaatcctttcttcttgtctatttgtatttcttcggttgtgtttctattttactgtttatttttacagtcatcaactaaactaaacaatcgtaataaatgcgtcataaatcatttaccgttacaaaactaggacaattcaaaacttaaaataggacaaaacgacttctaaataggacaaaataacctctaaataggacaaaataacctctaaataggacagattttattattaatattttataagttattgtttttattatatatattatttttacgtcctatttgtcctattactttttctatcgcgtataaaaaaagcatttttaaggtaataatagacaataaaaagccttgctagataacaaggctattattcattgaattgattttagattattcagaaagtgttaataatattccgcacttttcgcaataatccccccatgcttgatatgcttgctttctttcctctaggtaatcatatctatcatatatagcctgtattttccctttccctgttgaattgtgtgctattgccaactctccaacgacaacagaaaagccaatctgactaagataggatctaaatactaccctcaacccatgtgcgtcttgtttatctctatagccgttatcccttaatgcattgcttacagtatctagtcctatggttttatttctgtttctcactctagggaataaataagggcttgagccgttaaattgcctaattgtgcctataagtttaatcatttgtgaggataaaggaattatatgatctttgggctgttctcttagctttctagtttgtttcatgttctccgaggggataataagcaacttattaccatcatcaacaaaagcccattcaatgcgtgttagctctttctgtctcaaccctgtgagcaaagtcaagttaaatgcaaagagtgtattaaactctagcttaccctcattgaaagcggtgtttattgcctttaatagctccggtagctctgcaggtgtaatagctgggtgattttttgccagtggtgctataaaatcatcttttgctaaattgcaattatgcccctctataatgcctagcttaatgccataatctagagtagcttttacaagtctatgtaatttatcaagagtattgctagcccctatttctctgtaaacgtctattaataatctaggtgttatttctgaaagtggtatttctgcgagcttggggaatatatgcctttctaacctttgccaattcctcgctctagtgtcttcattgggtgcttttgttgggtatatttcagcataccatttagcacaaacatatttaaaagtgtttcgttctaatgcctgtgtgttttgtttttggtctctgtgtgttttaggatcgatattttgagcgagcagggctaaatactcgtctcttatctttcttgcttgtagtagtgatatttcaggatatttgccaatgctgatttctgtccgctttttagtataaggcttgtaatagttaaaacgccatatctttgaaccgctaatctctacagataaaaaaagcccgttgccgtctcttaatggataagctttttttttaatcttcgctttttctatttctgtatttgaaagaggtttgattaatcttgccataagtttagtagtataaaaaagaaaaaaataaagtgctttgcaccctttaaaatcaaggctctagcgatttttagtagtataattttttagataaaaatgtattttatgattttatactaccatttatactactaaaattcattgctttaaacatataaatacgaataaacacaaaagaataaaaacaataaaaggacgttaaagccagtatttacaagggtttatttaatgaatttgaaagagtgggaaagaatggaaaattgaagttggtgccagtggtcggactcgaaccgacacgcttttaagggcggcggattttgaatcaagtgcgtagaactgttcaaataatattcgcaaatacacacttactacgatgtatccagccaatacatccactaggattttctgtccgaattccagacgatcctgatcttacacattctttcaagtttgtaaagcctgataatgattttatagtatattttttacaggttagattacaaatataatatatactagcttgactttaggagataatcattataatctgattgtcaaggtggcgttaccttaataacgcaatgagttgttggctcatcgtcaatctgatattaatctaggatgtaaaggcctagcggtggcaggcaccagaaaactctgatactaatctaggatgtaaaggcctagcggtggcagacaccagaataaaccaacatttaggcccacttaattgtgggcttaatactttatgaaagaagcaaatatgactaataaatttactggatacaaaaaactaagcattaatgacttgaaaaaatttgagtataatttagagcatataagaaatgccgcaatctttttcaaagatcattttcttagtaaagaaatgatatatagtactgaaaaagaaagtacatccgttatctttcaaagaagcaattttatgcacttgtgcggaatatattatgaacccggtgcgagtgaattttttaatcttgccttattaaaacaaatagacctaaataaggtttatataaaaaatgatggcacaacattccaaaagttgtctgttttaagttctatagattttttaattaatccagagataactttgtcatcaggtgcaatttatttaaacctttcttttgataaagctcttagaactaaaaccagagtctttgctctcacattgataaatgacaatcacttatttattccacaatctttactgaatcttaggaccatgaatgatttccctaagggtaacaaaattattggtataaaatcagttcatttagaagataaaacagaaatcatctacttatagaaaaaagaataagagaaattatattctcccatttttattttatcagagtaaattcacaatcttgggcatttgcattatcaaggcaatactcaaaggagctcaatctttgataaatcatcaacggagaagtcaattaaggcacttgcaagaacatttaaggatagtgatcatacttatgggaagctcaggaacttctcagaagctccgctgtttcttgactcaaagtcatcaagattaatttattagctgatttggtttcctatgccatatttaggcattatgaacataatgatagctcattttacgatcttataaagaataactttgatcatcataatggacgtattcacggtttatatttacgaaatacagaggatataatcccataagtatgaagtatagaagggcgatatcctctctaataataaactctctcaacatttctatgtcatactcaatatatcagagcttaatactaatatcattatgcattgacaatttctgaatgacatagatattttccggtttcttcattaattgagtaacagcggtatatcaaaatctatatagtacctaagaaaggcttacttgcttagaaatatattaaaaaatatcttttagcttattttgaagcatatcttactatcttatgaatacataggggaaaatattctaaatttattctagcgatatacagagctttatcattaatagtattaagggatttacatctaatttttagatgctctagatagtctttctaccatatgaagaattgtcgttttatcttgttctgagctatttctataatagcttaataaaatttcttcttctttagtaatgcttaatctttctctaattctcaataccccactattgagcaaaacattttttatatcagaaagtatttgatttagaaatttttcattttctttttgaatatcatctatcaattcctgtttcaatgccaaagtttccttagttactcctaaactagtttgtacagattctggcatatcatacacgtagtattcaaaaacattacctttcactccagagacacgccgtctacgccatttatcttttttagcatataagattataccttgtggtgttgaagggagccctcctacatctaaaagctctttaagagtataccattctttcatattacctcattgactttattttaaatttaagttaaatttaacttaaattgaattaactttaacttaaaagatcaaggctaattcaaggagatctagtctacattaaattgagtgctatttgaagatcgcttatctaaatgaggttttgtatgagttttgaacaattattgcatttatttttcttagaacggaatcatagacctgccactatacgttcttatcaaaatgtaatagcgcagattgttaaattttatccagataaagaacctgaacaaatatctaagcttgacttattagaatggagaaagtattgcctcaataaaatgagcccaattacttggaatagttatatcagacatcttaaagctatttttaattatgctatagataatgagctatttgagtaccctaaaaatttatttaaaggccttatggtaagacctgataagccaaagaaaaaactactaacagaaaggcaaatccattttttagaaatctctttggaaaatgaggagaaattacctcattatttacaacctgcttattttactaaagctttaatctacactttaaaatatacagctatcagacaatcccagctattacagctaaaaatttctgatatcgatatgacaagcaaaattataaatataagagctgaaaccaataagaatcatgaacaccatgaaattccaatttcagataaattatatccatacctaaaaagattgatattagaatcaagagctagaagcactagttcagatgagcagttatttaacattaatcgcttttcattagttactacatcaagaaataagaaaatgacagaaggacaactagttcatttttttcgccatatttctgaatttataggatttacagtaacttcacatcgattccgacatacaactgcaacagaagtcctaaagcaatcaggggatatctatgcagtgaagcaattacttggacataaagatctcactgtaactctaacatatattcacaatgatcctgaaatgctaagaaaacatgtcaattcgttgtagaaatgatgctacatagataaaataagggactgacgtagattagtaagtatgctagtctacgtcagccccgattttttaattaatccagagataactttgtcatcgggtgcaatttatttaaacctttcttttgataaagctcttagaactaaaaccagagtctttgctctcacattgataaatgacgatcacttatttattccacaatctttactgaatcttaggaccatgaataattttcctaagggtgacaaaattattggtataaaatcagttcatttagaagataaaacagaaattatttatttataggctgaatttacaatccaagtgcaacaaaaaaagaagtactcatcaactagaatataattttgtttccacacaaaaaccacttccaaatgatgagtacttcctaccgacatcttacaataaacgagcgagaaaagataatgattttactcgcacagggcaaaaaacaagcagaaattgccaaagcactgggacgtagctccagcaccatttctcgcgagctgaaacgacacgctctagaaagctacagtgcaacgaacgcacaaaacagctatttgaagcatcgtcaaaatagcaaagcacagcgcaaattagagcagcctgaatatttcaatttggtgcaagaaaagtttctgacagaaaactggtcgcccgaacaaatcagcgcacgattaaaattggaaaaatctgaattatccattagttattcaaccatttatcgtggtatttattcagggttgtttgatataggcgaacgcaaagccagtcgcaaactgcgccacaaaggcaaaacacggcatacaaaaaatcatcatgaaaaacgtggcaaaattcagatatccaaccatttgaacgaccgtcccatttcggcgcaaaatcgcagtcgctttggacattgggaagccgataccgtactgggtaaagcgggtggagcttgtttgctgacgctgacggaacgcaaaagtcgttttgagttggtgaagaaaattcctgccaaaaaagccgaagcagtccaaaaagacatgattgaattgctggattcacatatattgcggtcaattacgccagaccgtggtaaagaatttgcccaacatcgtttggtaacagaagcactgggtgtagaattttacttccccgagccgcatcaaccgtggacacggggaacgaatgaaaatacaaatgggttacttcgtgaatactttccgaagcaccaagacatcaatcagtggagcgaagttgatattcaacaggtggtcaataaactgaatttacgaccgcgtaaatgtttgggttggaaaacaccttatgaagtttacttcaaaaaaacgttgcacttggtttgacaattcaagtgaaaattcagttgctgatataaaataatttagccaccttatttctaaggcggctattatttgttagtaaaatattagctcattatcatcaatttcatctaaaattgagatttgagataaatcttccactatcactgatttttctatattgttaccacagcctttctcagtagtgctatttacaagtggtgcaatttgttgctccagtttatgagaccaatttcccatcaaatgagccagcgtatacatttgaatttttgtttcattcaatagcgtatcaccaactacaatacaagcaggaatatgtaataacgatagctggatataacacatcatggcagctgtaaaatcaacatcttgacaatgaacccaaagttgttgttggggattgtatttcgcatcaaacatcgcattaacacaaccaatcaccattacacccgaaccacaagttggttctgataaagtaacaaatccctgttgtgagatgattctatcacagtcctgtagtgtaactttcgccattagatctgcgatgtgagatggtgtaaagtattgccctctataaccatcaccaagattgagattcataaatactgagcctaagaaatcatagcgtttttgtgttaaagcattcaccgtaacagctaacaattctgctaattgagtaaactcagaatctgaatatcgtgccttagcatgagcaaagcgttctcgcaaattaggttctgcttgatctcgatacgttactaggtacatatcaagtgcagagagtgtaataaaatcataaaacacttctgaacgtcgataatgtggtgcgatacgttgaaataagctgataaattgcttttcaaagttttccattagactactccttaaagtttacggagtaatccccctagggaattacccctagggtggaaaaattaattaaggctattcaagtttctcttcgaactcatcttcaaattcttcattaaagacttcctcagcaaaactgcgaatacccctatcatctatgtaaatattgcagtatgagccatcaagatttgcgatatatttgcccgcaaaccacattcccggctcaaaaaatgaaagtataaactcaatgtcaggaaaggcagtacaaagtgcttggaaccaaccatcaggtggtccccatggcgtatcaaataggcaattaatagatccattatcattaaagctaacttgacagctatctgaacatacattccatttacagccccactgttcatttgaccagtcataccaatctttgtaaccatgttgagctaggttagacagatattgctggcctaatgcgaggtttagccataatatactttgttgttcaggacgttttatcaaccagttgataaaatgacctacatcccagcgatgatgctttgccttagcatatatccgatcaatttcggacccatagatatactttttgagtagagggcgtgttaaacgtctatttggtgaaatttttagaaattccattgctctatcaccaagactacttgattcaatgcagattgattctggcattggaacgagtaattcaaagtctaaacaccatttatcactttcagtttttctgaaaagcttaggaataatttgtttagcttggatacaatcgcaaaaaatttgtagtttattttcacaccagtttggcataatgtactcctaaataaagtaggggtacacttgccttgaggcaatgtaccccaagggttaaaagataatcgatacataattcctaaaggattatgtattactatgaaagattgtgttgaaagtacctttcagcaaagagttaagctgcttcttcaaagacctcgtttttatcagccagctgtgagatatttaatgcatctaacatatattgacaagcttcacgagctttaccagaagcccggacaatagcccgtttatcttcttttataactcttatccaactttcaatatatgccgcattttgaggtaccgtatcaaatccaaggtaggcacacaaaaatgctccccccatttcggcaaccaactcctcaaaagcatagactttgtttccaaattttgcttttccggaggtaataccctcacgatcgagccttttagcagcaccagttgcatgagtcatttcgtgcaataacacactatgaaacgcttgagcattttcaaactgttttatttccggcattacaactaaatctgcactgggttgataatatgcccgattactcggtttcatttccacgtgtaaatccattcctttgataatctgccgaatatcagcaaaaatctcgtattggtttggatccgatgtaggctgtttaggttctgatataggatcgtacagttcctcgggtaaattttcacactggtctagattgaacagattgtgcttcttaatgaaaaagtgttgttcaatttctggattaccttcctcgtcatacacaatatttccctcctcatcaagtttttctctcttatcaggacggtagttcattacaacagtagctttttcacctttacggatatatccgccgagctcgttagctttttttgctgtaatccacttactctgtttgtaaccgtattctgcggtagcaatccagagtaatagtgtgttgataccagaatacaatcggttagagaccgcattacgaggtaatgccatattacattctggatgactccacggttttaaccatggtgcagtcccctgttccagtgctgcaacaattcggtctgtgatatgttggtataaatcaaatttagtttgagtgttcattagtgtttctccaaagttcaggtagaaaatggggaaacactattacccttatcgggcactagtttccccgatgggtggtttaaaatctcaacagagatagtttttctaggttcatcaaaaccagtagaactgcctataatgcagtaactacagataatttgttaatcagtattgattcaagttaaacataatcctcatatcgaaaattactttggtaatacaaagttacattatttcagatccattaaagtaaacgttgaaagctattagcagcaataaagtgataacttttttccgcagcttctgtttccgtaatcattccctgctccagcaaaacatgggtgattccattgaaaaactgatgtaatagaaatgaaataaaacctgttgtttcaacttttactgggcgacaatgaaactgcatatcctgccaaagtttaatatcatcttttaactgttgagagctcacaatttcatatacaacagcagaaatattaactaaattaccgttgttattcagccaaattgtataacgattccaatctccttttctcattggctctatacaaatgtgaaataggtattggtaggctttattatttaaattgcggttatcccagatgtatttgagtaaatctaaatcgtgtttcataatgtttctccaaaagaaaaaagtggagaaacatcttacctatagggaaaatatttccccacagggtaaaaaacaatctcgataagcggtcaaattgaaataaaaaacctacaaatcaggcatgcaagtaggcaaaacgtgcggcattactacgagcagaagctatagcattactaataagctcttgtcgataaccactcaatgaatggtctgtcggcgaatagcttacgcctgtaatttcatcgctacctagttgaatgccactttccttatcagtaacggttgctacaaaatcagcatagcaaagtttcccttgtaggatttcctctatcattgcctcaaaatcgcagacatcaccacatagccaatcaacagactctgaataaaattcagaggatttacgtttaagttctatcagatagttttccgtgttaaatttgaaaatagtttccgtctgatacggtgaggcctcaataatctgatagccattcgattctaaggcacaggaagtatctttaatatactgacctaaatcttgaataaatccatcccacagggctttgtatttttccacttttgatgtagggaaataccactcttttcgggcatcacgatcatagaaaaatgccaaatcatctgctgttctaacagaaagctccatcgtattacaatgcgaatagcggtacccaaaactatttcgtatgatttcaaaatccacgccatagtgaggctcccaagattcaatgtgattcagcagattagaaaacattttttgtgtgcgtttctgaggatttagcttgttgaaaagattaattaacgtctccgtattaagcctaccgtagaatgctacgccatcgccttgacaatgagaaagtgaatactcaatgtttaagcaattaggaaaaccagctttaacaagagcgtgtttaaaataagtgtttaagactgagccagacattgcgcttctcctaaaattagagggaaacacattacccttttccggaaattgtgtttcccgaaagggtgaaagattgattaccacttatcgaagttaatcgctctgaatttataaacggatataggttgatcatagagttctgtttccgaaatccaattgtgttcaaccaagatttctctgacaagatacataaatgtactcatcaaatgacgactatgactaaacccgtttccaccaacataagcaaaccctctcagggttttgcgaattcctgctttaacaacaaggtaagtaatatcaacctcgccataagacgggcagacatcaaagcgagaaaaaacagaaaatgctttgccaaacttggtctcacgctctaatttcacactgaatagatcatgtgcatggcgtaaattccaaagtacactgtataagtgcaaatctgtttcggtatattgaatttttttacgagccataatgtttctcctaaaaaataaaagggaaacattacttccctctggggataatgcctccccttgtgaggtataagaataggatgtgaatatgaagttgcctatgctcgactaacaattagcttgccgttctgctcggacacactcagaaagcgaaaattaagtccttgccgagacggcatttgttgcataaatcgcacgcttttgatgtccttatctcgattttgccacgcttctaaagctctatgactaatttcttgctgtaaggcttgatgctctgatgtccattcattaagtttagttggtaaaacatctccaatacaggaaagtctaatatgaactaacatacatttctccagaataaggggaaatgcattccccttaagggaaacaacatttccccgatgggtgagttaaattagattaaagagagctgagtaccaaaaacggcagccataccacatacaaaggcaataatggcagccaacaaagtccagaaaaacatcttacgcttaatgcgggaaatttcctgttcatattcggctgcttgttcgtctaagcacatttgcagttctaaggctcgcatttcatcttcttcagcaatccgttgattgatgcctttggtgacttcaacatacttgcttttggctttatgtttcgctgaaacaaaaatattacctagcttgttgccaagtttccaaaaaagagaaggttttacggttttggatgattcaaacgggataacatcccatcctgcggtttgttgactcatagcgagttctcctaaaagttaagtgaataaaattcctcaggagatcgcaattccaagggaattgaaatatccctcggaaggtaggtgtgtaggtagcattcctgcaaatttgcagagttccctttcagaatgctgggagacattttgggtaaataactcaactacctctaaggatagccgccgcttttcaagagttatgcgacttttaagggctgtatctacagcgtcttaatgcttaatatcatacgaattcctccaataaaatcaaccgtttttttgttcaaaaaatatctcttttttgaaaagagtttttcctatcctcaacataaaaatctcgctaattttctgcttatttgttcgggaggagagcgtgatgaaagtaagtagatttctgggatattgcagtatagtaacaggtgtgttttcgccccttgcacaagcacaacccaatatcatcgtctataccacaaagatgtaccctattcaaaattcacaacttgcttcccagatttattatcttgaccaagtagagaattttgaagagtcaatcagtcgaaacctcagtaaatcaccagagattgccgaacaagaaatgcgtgcattctttaattcagcagattggaaagcccaagagcaacaattaaaagacgcttatcaaggcgtgatcagtggatggcaaaatggcattaagaaagtacctgcggtgttttttgataatccacaatcttctccgagtgtgatttatggtacgactgacgtacagaaagcattagatgaatggcataaatgggttaaacaacaaggtgaatcaaaatgaaaaaaacgtttcttacgatactgatctctgccagtttagctgtcccaacaaccttatatcctcaaccagccagagcctcattgaataccgcttccattgctgcatcaagtgcctcaacaagctgtttggaatataaagttgttggaacctgtttttggttattttgtacctactttggatgtaaggttcgcacatcaaccaaaattaagcattatttacctgaaatggttgtttcatcttataaccacgatgggcaaacgccatggacagaattacaagctctcaatcctggtgtaaaaggtggagaataccgttctccacaacgccaatactctcaactcactttcaaaaatgcggatgcgtttggacacccacaaggagctatcggtcaattattaggaaatacggggtactattgtaaaactcaaactacgccatttatgccttactttttgagtgggctggatttttttgcctggcgtgaaaatatgccggaaatgttttacccggaagctctgactccgggaatgcgggaagttggccgtgtaggcgatagctggggaaatatttacccacgttccggttgggtaacccaagcacacgattataaagcctctgcgaccattgtgcagagagtggcagacattgtgagccgaacagctcagccacacatttatttcccagcagccaaaacaggtggtgcaggagaatggcctccaggaccggtcgaagagggacaagcaagaacacataaatggcaaatactttaccctcaaatgtcaaatacctgctctgtttttcctaatggagggcaaacagatacctattcttctcaaatttcaaatcaaggtgattatgcttgggcattatggcgaccttatagttgttgcaaacgccgtgggcaaacattcctttacagtattgattggtcacactaataacattgggagcaataatgaaatctcactttaacttcaaaaaatcccacttacggatcacgacagcattattatcaagtgtatcaggactatcttatgccgattcgattacggataaactggaatttagtaagtcggattcgattatttcagaccgtgttttttaccaaatcggcggtggaatgggttatatggctccacctagtcgtggtaataccaaagttgttgatttaggaattggttggaaagcgaatttaacctgtggtaattttgatattaaaacgaccattaaaaatgatttaaacggtctcaaagacggctttaaagatttaatggggaatgtcattgattcagcgaaaggtgcggttgcaagtatgcctgcaatggtattgcaacgggccaaccctcaactctacgatttactcacaaatggtatgtaccaaggtaagctggatttcaaccgtcttaaaaccagttgtgaagaaatgtccaaagttttagcagatcatacactgggaggaaaatgggggcaagcagctgatttagaaagctataagcaaattacctcctctcaacctgatgcaaaacaagctcaaaaagacctggaagataaaaaagggaaagatgggcgagtttggataggaggtcagaaaaaaggtggggaaaaccaagaagctatcaatgttgttggcgatgttgtcaaagctgggtttaatttactgaacaaacgtaatgccttagataccagtacaatttcaggttcaagctgtgatgggaatctttgccaaacttgggataatccacaaacagcagccgattttttaactaagattattggtgaacaatctatttcgacttgtaaagaggattgtggcactaaaaccagctcaaaagccggtgtaggcttgagtccggaaattgaggaagaacatgttcgtactattgtcaaattagagaatgtactgaatatggatgtgcctaaggctgaattgttagctgatttgagttcaactactgtaccagtaacaagagggcttattgagagtcttcgagatgatcctgatgttgaggtattaagccaacgcttatctgcagaaattgcgactagtaagataatggaaaaaatgctcctggctcggcgagcagtcttagctggtatgcgtgagccaaatgtcgctcaaaatgcggatgcacaagtagaactggaaagagtactcaatattattgaccgtgaaatttcccaagtaaaactagaaatggatatgcaaaaaatgatcaccggcaatacggcttcggtgattttgcaaagcaaatccgaacgagaagctcttgctggtgctcatagtttatctcaagacagtctggataaacgtgttcaaggacttgaaaacggtaatgttgcattaactgatttagaggcaggctctaatattaacctctctcgtagaaatattgcattgagtatcccgaatattccgaatgtagctgctctcatacctaatctgccaaatcgaggtggttcaggtgtaggtggaaatttcccatcactcgcacaaatcagcggttcaacgatggatcaagcaacaggattactacgtaattttgaaggctttatctctaaggctcaatgggatgtaaatgctcatcgagtaggatatggttccgatacaattacccgagctgatggtacgatcgtaaaagtaaccaaagatacggtcattaccaaagaagatgcagagcgtgatttggcccgccgaacagctatcttcgcaaataatgtgagaaaagagcttggagattcaaattggaatgcgttaccgccgaacgctcaagctgttttagtgtcttatgcatataattatggttcacttgctaaaacaaaaagcgtacttgatgcagccagaagatcagctcaaagtggtgatatgaatgctttagctactgcaatcagaaatcgccaagttgataataatggcatcaatgcacgtcgccggaatcaggaagctgactatattctcggtaaaaattaacctcataaggagttacatttatgcgtaaattattaggtattactgtacttacactttgtacaacttcagcatttgcaacggataaaaatgtggtattttcttgtaccagcacagaaggtaaacctctcacagttaaacgggtaggaaatgattacgagtattcgtatgataaaactatcttcaaaaacccaatcaaaaaagcggtgaccaacgatggctcaattatcgctagaggatcaggttttaccacgtatgcattagaactgaaaaatgatggtttgaagtatgtagttgggtttgttcaaccaaatggtaactcaaaagagtttattgagcctggagcaacgattagccgtgataatgatcaaccaagcattggctctgtagattgtgatccttacaaaaaaatctattataagtttgatgttcatttaatgaataccttgtaatgcgataattcaataatatgggggaatggcttgatttttcatcccccatactctattatatagatgtggtgctagagccagcccacgttaaaaaatacaaagctcggtagatgaactattgtggtgccagagccggcccacgttaaaaaatacaaagctcggtagatgaggccccttaagtcgtaagatttaaggggttttgcttaggatataaaatggatattacaacacaaaatattgaacttagatacttatctgagcagttttaccttgatgtcgctccacatctgaaagaaattttgcttaaagagactcgcccatactgtgttctattagttagagttaaaaatttagattttgccctaccattgcgttctaatttacctgaaagagaaggagttggaattaaaacgatacctaatcctcaggaatacggcaaatttaaaggaattgatttctcaaaagccattctactgacagataaaagctatttaaaaacagataccgttcagctcaaaaacaaatcagaattgttgaatatccaaggtaatgagcgtagaattgttcgtgaatttaagaaatatgtgagtgaatatatcactgcacataaaaacggttataaattagatcataaatttgaatatacaactttaattaattatcatactgagctgaaaatcagctaattagaataattggaggagctatgaaatttatcgatttcggaaagcagctcgctaacccagttaaatttatcaaacagaatactgcatttttacctaagcctattcaacaagtggtcgtttttgcggtaatttttgcaggattgcctctatttatcttgggtttctttattctcagaatatgggcttataagcatatttctttgtatagtgaatataaagatatggctaattcagaaatatcgtctaaagatacagatttaaaatcacttttttctgatgatgaagaacaagaagatgatgaatatcaatatgggtatgatggaccaggtatatatctaggtaattaccgtgttgatgagtaaaagtaaatagagtggtatataccactctattattcagttgttagattatttccctatcttggaacccgctgttttagagtctctagaaccagtagttaaatgacttgcaaactctcccatttttactcctacccaagacatactgcctagccaaatcgctggtaagaccaagaacatagaacccatcacaaaattcacaataatatcgtcttgtgtattttcaaggaaataagggtttattctgctatgtgtgcctgaatcatagaggaccgacagcaaccaagagtcaagccatctagctagttcccaccaaaatgtgagtgtaactaatgcgaaattcacaaaagttagcgtaaccaatgtttttaacgaataaccactcataaccataattaaaggcgtgagaataatcaatgccattaatgcaaatgaatgcaccatcggtaatgcttgccgcatcgaatcaaaagcagggaatgctccgatactgcctaatgacagaccaaacattgaagctgttttagtcacttcatttgtaaatgatctgtctaaatttcccccatacccgggataaactttccctctcgaaatatccatattctcagctcgtaatacggtacgaagtatggattcatcggaattttctttactgctgaaaaaatcaatcacttttgcagagaagttctgttttacatcatctaataaacgatcttttaaaccattattcgccgtatcccaccactctgcacaatttggaaaaccaccctctccattattcggcaatccattatcccgagaagcattatagggaaatagactatgaggttgttgggctcgataacggggataaagctcgctatttgcaatcaaaatacggccacctaaccagctagtctcacgaacctgtgctgggctcaatgaaagttggctattttgaattttctgacgtgccggtacatagcattgttgtacaaataagcgaacctctgtcaataatgctggattattgattttctcgtgttgaacttcaaaacgaacttgacgtaaatccggtttgcagggaattgaagctgttaaggcgtgtgttacccctttgttgatttgatgaaataatccccaccagatagggactctcgcttgttgatcacccaattcagagttcatttggttataaccactatcctctggtgcagttggaacacgataaccacaggctttagaacgttctacattcaactcaatattattcaggttgatcggtatcattggagctaagaccaatacaacgacaaacatcgccgggtaaaatttgaggctgagccaagtaataagtaaatcccctttattaccttcgtcctcaccttgttttttgacttccatccacgtactgattaagacaaaaatgagaggcagaacaaacaaccctgtttgaaccaatacagcgaaaatattgttgttgatgatccaagccagtaaggtaagaaagtattctaagtaactatctacggtaaaggtcatctcatcctccttaaagtagatacagtaaattaagtccctcaataattgggatgacagataaaatcattaacctggcttttaatggcatttgcccttttcgattaagttgtaccatcaatagccaaatagctacatataaaacaaatcgccatcccaaccaggcatagcgggtttcatagaaccacgcttgaaaatttgtggaaggaaaataggtcattgccaaccagccaacaacgagtagtaataaaataataccgatgatcatcaaggttatttttaatacagtaataacccttgtcattttaggctttgttgtatcagacttcattattatctattacctcgttatacacagagttatccgcaattgatgtggataagggtaaaagattacttttcaaaccgagatactgagtaaggaatgccgaaaaccaataagcatccacatgatcagctatttcaataattaaacgagctgaccattcactgttattggaagttggtagcaaagaacgccccgtcacattaagtaataagtgaacagaaccctgctcaccagaaagttcgatagcccagtgattttgcacgacacgatgagggaataaggtaatctgtttcccaacgccgatgagttggcgaatttgttcacaaaatccaagcaattgagtttctaccgctggagatacaactcctaatgaggatttttgtgggcctgcattaaataaacggtaatgttgtttattcattagtgtattcctcttgctttatcaatccgagctgcaacctctaaagctgcatcgagttcggtatagccgtgctgcatcatcagttgcttacgttctgctttttcatgtttttcagtcattcctaaagctaaaaataagctaggcggtacaactcggaatagagcttccatattcgttgctaataccacgccctcggtatatttacgatctgattttttggcagataacaacatcgttttctgggcctctgacagtttccggaaacgattgatttcatcaatttcactggcagacacattcaacaattcccaccattcgaccattgagagtaatttcgccgcttcattcgggaagtcatccatattttgagtagcaagccatagccaaatccctagtttacgccacatttttgagcctttaactaggaatttagctaataatgggttggccgtgataatgtgtgattcatctgttacattcagaatcatccgatcactgtgttggtatttttcaccaagactgttgatatggttaatgagtgaaatataggaaatggccaactctgcttcatagccttcccgggcaaacatagctaaatcaactaaggttagatcagcctccggccaaattgccccctctcgattaaaaaattgcccatttacaccggtacaaaacatttctaatgattctgccatttctgctaaacgggtacgccgttcttcacgagtatgctcatcatgacttaatgcttccaaagcatttttaatatcttcagtcagcgtttgtctgccttcagatttggtttggcgagctgcatttaaaatggcacgacgaatagcagcacgatcagcacggctcattttttcatcttctttcttttcacctccggtgatcatcaaacgtgccgtcagctccatttcggccaataaatctcgttgcatatcaccttcatcatcagtgtcatcgttatcctcaatgtcttccggcacatcttccgggtttaattccatatccaatagacgatgtgcttctgaaaagagtggtaagacaatgccgctgtttggagctaacgtaatgcgatttacagtcagtccgaaacgttctgcatagtccgctaataaaccaaatgaatttcctgcctcaacaacaaaagtccgtgggcgataaacggccatagcctgacataattgcccacataacgtagctgattttcccgaaccggttggacctaataatagcttgtgagcatttttggttctgtctttacggttaaatgggtcgaaattaaatggtgctcctcctcgattaaagtaagtgatccccggattcccagtcccggtatctcggccaaagataggtaataagtttgccaaatgttgtacaaaatagtacttcgtgtagtaatgtgatttggcatccatctgcggattaaaattcattggtagccaacgcaaatagctgttaagtggggcaatttctgcattttccttcacgggttctaggttgttactgagcagaatcgttctcaactggcgagaacgggtacgtagctccttttcatccttacctcgaacgtaaaatgcaatagctgcttgatagagtttatgcccctctttaagataagactgtacagtttgacagtcttcttttaggtatttcgactcaaaattttcacctaccgctcgactactaattttttctaaatgtgcctccaacttatcctgtggatggatgacgatggtaattgccataatggttgattccggcaacaagtcaaataatgcattgatattacgcccacgagtaatctcgccagtcatcaaccccacttccggttgtttcctcaaattattgactacaacaacttcgtgcggttggtcatcaaaataccaatagttgccttcatttttcggttgagaataaaataaatcttcactgaaatcgttaaacgctaattctggaagcccgtcatttgaggtttgtttaccaaagagatggtagcaatcattgttgcttaacccctcaaaattaatagaaggattgggattaaaccaacgtaacagccattgacgaaattgttcgccatccagtcgctgcaattgtaatccagcagttgttagagctccatttatgcgagaacaagcattgttcagctgctcgacaatcagattttcattagtgtcattggatttatcaacataccgatagatcaccattttggtactacgtatacgaccagaccaagctgtatttgtcactcgctcatcaataaaaagcccctctggtttaccgatatccttgaaatgcttggcttgtacccgtaaccattcttcgctaaatgcactatttttagcgataggcgagatataatttcgtagctgttcaatataaggctgtaaatcatcgctgtcttggcaataaaattgaacaacgtacggatttacatccaattcatcaaagctgtcttgcaaggcatctttgacaagattacgtatccgacttaaaaattcaatactacggccagcagtaccaatcggcttaatatcaaatactgccccaacactacgggcatcatcaaggagtatcacaccgtgctcattcaaatattctccccaaggtagatgatcgataaaggagggctcttgtgagtataaccgacggtgatgctgtgactgggtgagttttccactgcgttttaattgttgaacctcgttatttacctcactcattttattttgaatgatgtcagactcaccggtattttcatttggttcacttgatataacccctgctttagtcggtttgaaagaggaaaatacctcacttaaaaaagacatgattaaagccctcttgttctatcacccggctgagcatattgaactcgtccatagaaaggtagtactgtagaatatcctggaatactgagaggctctccggaacgagtttgatgtgggtacacatacataatcagatccggattaggtaaacgagggaacaagttattaatttcattttctgccgtacgggtataggctcgttgctcactattaggaatataatcgacagggtcaagtgttcgcccttgttgtgaacggtataagtgtagatcgttattactcgctcctttatcccaaatatcccgcatcgtactgccgttagtaggtaataattcttctgttgatgttgtgcaacctgttatcaataaggcacttatcattatgcaaaataaatgtttcatcgtttgttccttctaatccagttgtgaattcgttgattttgagccatatttcactttacgaccttgggcgttgtaatcgatttcaatctctttctcgatatgaatagagacacgatgacccggtggcacatatacagcatcaaagttttcagcaaaacgttttctaaaccagtcagcagattcttttaagccgcctccgatagcttgtcctaagatgaacttaccctgatcgccggtaacagctccaacaacactacttccatcaacaacagtggttgtttgtgactgtgagaatccttgggcagcagcacttgcagcagccaaaaagaaattcgttcccaaatattctggggcattggttttccgctctcctggaacacaagggatacccgaactatctgataaccagccaatctcttcgccattccctttattagaggtactcacaatacgtccatcattgaacacaaaagtcatactttttacactgcctctaacacaggatagtgtccagtcgccagtagcagtacctgatacaattgctccgtctacatcaggtaattcaataccattagcaatgagattttctcgaccaataagtactttgaacggataagcatccgatactcgattatcaatcgggatacgtccgatgagtcccgtcattgcaactgaatcaaggaatgttgaattacttggtatggtatatactgatgtcatctggtttttaccacgtgcgtttccagccgttccttgtgagcttgtcacagtatctgtttccgggaaaaacggcagacctttcttttcgttatttcctgcagattgtcctccattaaaatctttcggaaagccaaatttagttgctactgtattgcctgacacaggttttccacttgcatccaaactaatctgatcgcttggttctacccaatacattccactggtatccacgttggacatagttgcaccaccgataggtaatttatctcctgctgttccaaatcctttattcggtaccgtattaggctgagcctctacctgaggggtagactcttgtgttgttggtttgttattaacgagagtcgccatatcaaataattgcattttcaaatctgcaatctgctcttgcagttttcgggtttcattatttaccgcatcattgatacgaccattcactaaatcttctttctgtttgagttggcgattttcatcaattaactcatccatacgacgctcattggatttaacggttgtcacaagggtacgcagcgtatcaatcggcgtatcaccttgaatacccattgttctgacttgttcaggtgttaaatctttaatggaaatatctaaaatttcctgttgtgtcggttgtggaactgactcactacgtccaaataaggcatagacaattccaccgactaagataaatacaatgcccagtatgacaaataaggctttattcgctttcattgcctttcctcctacttcgccgattgagccggtttagtttcaacttttgttgttcttttcacttttttactgactagtttgactggacgggtttccggaattaatgcgttattagcatagccttcggtcactaaatacagggttgtggtatcttcattttctccgtaccccccaagccaattatgctggaaagtcgctgcataaaattgtccttgaagctctcgagggtcaagcgtaatttgagtgttacccttattttgcaaacgaatagcggtaactacatattcgtctaactgccagctaattaaaggtgttgcttctattgaataagccggtagcagcttggtaatttttttaggtagacgatgtgccacacgacgcacaccatctaaaggttcaactgtacgtagtggagcataaagtgattgtgctgcataacgggtcaatgcggcaggtactggaagctgaggacggctattcgcaataggcagatcagagctttcatcatctctattgcttgaaaaagattgtttttctaccgtaccgtcaaaaaccactcgaattgcctcttcaggattagcgactttcgaagctgctgttaaatcaaatagaaaaatttcaccggttgtaacatcacggaattctatgcgagtggagggaaatgtttctaatgcttttaaatagacggctccaccggtagattgaattcgtagcttaccgtccagttctgccggataaccaaccttgacatttttatcgacaaaaataattcgttctttttccacttgtaacgcaacaggaagtggttttctttcccatttcatcaatacatcagccaagctactcccagagaagcctataagcaaagagacgagcaaaattggtagacgtttcattattttttctcctctgtttttggctcaacaccttctaagagttttggaatggagtgatagcaattaaaccctaatccccaagggttttgagcagaatcgacatccattctcacaatactgataggaaaacgaatataaactcgttttaccggctgtccttggaaatgttcatccacacttaaatcaagattgacagcccaactatcttcactgaatatggtaactttatcttcactatatcctctaccggtaatttcatacaccatacgggttcggctgcgtagttcattgttacgcagacgatctttataatcttgtcgtaaaaatgcttcacagtgtggtgttaaaaatggtttgagggtggtgatatttttctcataatcctcttcgccatttgtcatccaccgattcatttgctggaaaatttgataggagaatgcataaattgttggtttaggaatttcccaccaagctcgttggctcccagcacgcagatctggtgggttgtatatcgtaaggcgacttgggaaagtatagattacgcctgccagtaccaaaataataatgaaaaacaggaaggcaaaaattcgagtcgttttgatatgtttatctttttcgtgtaattggctttttaactggctcatttgttatttccttctatatcggcgaatagaccaaaacccttctcgttttataaacttatgaccgttaaagaggtcatccattttcttttcaactaatctatttaaataagcctctggttttcctcgtttaaccgcagcgacaataccttttccgattaagacagttgcgatgcagagcaacattgccattgccggaataagaagccaaaaatcagttaatatccacaagaagagaccaacaatcagacctaacataaatcctaatccggcagatatgccgaactcactaactgtcatcccaccgtaaacggtagcttcacgattaaggcgggtgggaagaaaaggaatggttgtatcttgttctgacatattggtctcctagacattttaattagaagagtccgactgcaagtttgactaaccacaagcagaagaaaatcacaataaagccgataattaaggcgagaataaagtgtccccaaccttttttaccattttcagatgtagcttcgttatagatgccaatcaatgctttaacaactgtcaaaatggctacggctgctaaaataacagctccgagagtgacaagacctttcagaacaatccaaataatttccattggatctttggtattactatccacgcctggaatttggaagtctgggattttggaagcatcaggaccggctgcaaatgcattttggagggaaccccagaagaagagcattacagccaaataacgactatgcagatgtttcgtaagagatttaatgcggttcataatagacctcgaatctaatagataaagaaataagtaacacaagctaacagtgccactcctttgagaaataaaactaaaagtgaaaaaggacttttatctctaaatgaaaatcccttataaccactattcaatgcccaagcgacggctaagagcagtaatgaaagaaaaataatggcgatcatgattttcaatctaaaagggtcgataccgctggcaacagaaaacgcattcgcaggggagtaagacatcactgcccccgtaatttgctataatcatcacttaatgtacgtagtacattcggatcacgaggtaatgctcggcttggattgatatattgttgaattccttttttgacggtttcaatatcactgtgaatagcagaatagttaaagtattctcgtgttttaggcgaggctttagctactttttctgctcgttgaagtgataattttgccgcttccagttgcttaattgcctgggctaattgctcttgttctgttgaagcaagtgctggcaagcaagataaggtaacaaggacaacaatacctttccttaaagatgttgaaatagacatagtgcacctctatttttagttttacttcaggttaagagtgccaaaagcgatcctaaaatttaatggaaaactctgttaccgttcagaagagaaattgcacaaaatagtaaatggtgagaaagatattattctatgtttaagctagtcaattaagtagtatcaacaccgaaatcttcacgctttacgatgagataccagatgagatatctagcactgttccttgtagttttcccatatgttgcccattctcttccttcagcacagaaagtggggaatatttgccatgcagaaaatgctcaatataattacggaggtctttgggaattaagtttaagaggaaagttaatctgtaattattggcaatttctaggcgatgatgagcgaaaaaagatagagttacaattggatgagtacggggaatttcctatttggaatacctctgaacaaatttctgaacaaatcattgaagatgatgaatatccacaatattgggaagtcgaagactgggaggattctgattgggatactgagtcagaaaatgaagatacagaggcaacaacagaagaataagcccccgcatattgctaagggcttatgaaatttacaagaatttcttgaaactcgccgcagttatacagatggataaaccaaacaaacaggctgctgggactaaaatgatgttcggatgaattgaaaacgggatagataaataaagcacccaagctgtgaccatcattggcataatataacgtctagcgtgatggtataggtaggctgattcccgcccggcaccaaattttcgtatatctcgtaatgacagtccttcggttaaaccggaaagtgcagtcaataaaaagagtgggctggtaaaaacaataataatgaggcgaataataaaggtgatcaccacataaataacagattcaatataggctctgccgtagtgatgtacccactgttccatactaccattacccggtgaagttaaccactccttaacacccgtataaacgaataaccagttatacacgttttcaataattgatgttgcaaaagcagtagaagacttggcaaacaggctttgagaaaagtcatccgatagccattgcatctcattgagcatcatcgtttggctatgcaaatgcccttcttgcggccaccagaaagcaatgcctatccactctaaaataatgctgaatatgagagatactgcaattgcagcaagcgacatatttatttttccaaaaatcaggttgattaaacctgattttcggcgagctttagtttcttcactcattgcaaactatcctctctatcgagctggcactggacaaggatatagccggaaggattattatcaaaagcaagataaaaagcgaaaatatctttggatttatccgagtgacgcatagatacttcatcggcagaccataacgaaagcccttgatctgcgaatttttcggcaaactgatggaaggaataaccttgttcaaaccattcaataaaataggattgactatgaatcaggagttcttctgcattatctaagccacaggaagctgaaaactccccattaaaattacggtatttatttggtaaatctaatagattggttcttttttcctctctcattttggcactactcatcattttcctcttcatcaatatcgtaaggttcatctatgccgaaattatctacttgatggtctatctgtgttttatattgaggctccgacatcgcttcaaatgcttctgcaatgtctcgggacggcgtatattctgtaaatgccggttgccaccaattttcaacaacgtgatagtttttacgcatataatctgtcagctctcgtaaagattgaggcatcatatcatctttatcgacagcaggtaacggcattcgaattttccataatttactaccgtccattaaagcgaatgcttgtccttttggtaaattggtaatgttggccggaaccaacataggaacggtactttcgctgatacgctgtccggtattggagctaaacgccttatcatcgtcaggattactggagtcagttgtactggacgtgaccgtgctacgtttaatcgtcacttcgtgtaactgttttgtgagtaattctgccgtagccggttcttttaccctcagcatatagagtgtattgaagttacctaaggtttgtcccgctttcggtttactgccgatacgagcttcaatgtcggagagtgtttgtgtataagcagttacttgtattccagcaccaccgcctttgttgatgagagggataaattcatcacccatcaattcattaaattcatcacaatgaagattaattttcactggtttggatttttctttgaatgctcccggtaatccgtcatttgtcccaaatttatataaatgacctgccattgagactaagtcagcaaacatactgtttcctacagcggccgcaactgtcgcatcagagagagcatctaaaccaatataaacgattcctcgtttacgaataatggattcccagtcaaaaatcggacgttcatccaaaatatcagcataatccggggataacagctcagaaattttccctgtcgttaatttttccaataacggcaacaatgaggcaacaattttatcgaaataggtacggtcatagcgtacagcactggcaagtccttgtagaattgggtcaaagactgcactttcagcaatgtacttgttgatcacaaaaatcagcggacggtctttcattccgaaaggaagtgctttttcatccagtccagcggcgatggttgctaaattttcccaaatttttggatcggttttacgaatgaatttttccgcataatcaaggaataatgaatcaatattttgtacaaactgggaaatttgaacatagtttgggcgatttcccaattcaactaatgcacgtgcgacgatattgacaaatcgccaagcgaactctttaaatgccgccgagttacccgctccacttagctgtcctgaaatacgcccagcgacttccgaaatacgattaaagcgtcctactgggttataacgggcagaaatttcgggataacctagatggaaaacataaaactcatcttctcgccccgctcgttttgcctccgcatacattcgtttgagcatatcggcatcgcctttcggatcaaagaagactaccacttcacgctcatcagcagttttacctcggtggatatcctgggtaacaaagacctcagctaaacgagttttaccgacacgtgttgtaccgaatactaccgtatgcccaacccgagagctaacggattgaacgacatcaacctcatccggctcaattccatggatagcaggaataccctcaacaggtggcagaggtctaaccagattccaccggctatcctttgaggtaagatgtgttagccaattttcgtgtcgtttttcatactcacgagccattttaaatagcttagaaggctccagatattttgaaccgttatccgaaaaacaatcgtgtaaccgttgagtgtgaataggtttccattcaaatcccttaccgacaaacagatacttattactgaccggaatttgcttgcttgtcattgaataattaggcaaacgtttcaggttgcgatggtaacgcacaatttgccaaccttgttttgcccgataaaagctcaatgctccaaaaccagctgcaatactgtaaccgatacttggatggagtgccaaagaccaaggagctgcagcactgacaaaggcacaagaagcgtgaaccgctgccggaaaaaattcaacaggaggtcgtaaccacgcctctaaggtatgtttagcagacattattgtgaaactccgctttcagtgattaagacagggtaatgtgcaataccaattcgctctgcaaggtcatctccgggagttggtaatattctcagttccggtacaatgtctcgtaattgattaagttcggagagtgtttgtacattcactacaagccctgttgcattcaacgtgatcaacttctctcgattttgttgtaaccactgagctgaggtattatctgctccaattaagaaaatggcttgcattccggttaaatcaaatggtttttctttaatagtcccgggagatagtttatgggaaacaatgggtaaaatatcagcctcactcactgaggctgaaatggaattcggatagtttggtgcattttcatcgtgttccggttgcaaagattcataaaaacgtaccgcactttcaccaccgaaatcagcaatcacggttaaatcagcccaagagaaatgggacacatataaactaaacaataatacttttaccttgttttgcatttttacctctgaagagtattttggggttctacccaaaccattgcatttttaggttcaacccaaatcattttattatccggctcaacccatttgaccgattttcccatttggcttgtgggataaacgaaagctgcaactccggtatgaatatgcccttgcttggagacagtcataaaattggcttcttgcttatgtgctaaaaaacgtcctttttggtaattgagaaagtctcttaccgtcatccaacttttcattccattacgacgcatatttaaaatgtcttctttagtagctttccccatcattgctcgatgcagcccatctaagccgatattatgagccatatataaattctcatcagtaatagggatattacggagttgaaattgctcaatatgccaacgtgccaataatgccgttgctaaggtattcgtatatttatctcgacggggatcggcgtaagaaccccgatttttggctgtaatcaacttcataccaagttgctttcccctctctgtttcagatagccagttccaggttcccatagtaaactgcccaacaccggttgctcctgttggtgaaatgttgccataccagccatcttccattttgacaaaacctcgtagcattgcttcactcacctgataacgttgagcagccatacgaatatagctgtcaatttcagaaccaaatccattgaagggctttgcctgagaaatgctaatgttggaaagaaagactgcaacaatgactaatacacgagtgatgtccattcaccatcctgtttgatttggtaagcagcgggcatttttcctaacgaatatctcagccaatagcctttatcgtggttaagggtaatcaatcttttactgacttttattgggtcaatattattgtcggcagcccatttacgaatatcattatcggagatgttttgcccaacaatataaatatcgagaggtgtttgattatttgcgtaagagaggattttcccaagatcacttttacaagaatcgcagttatcaaaacgggtaaaataaaccacacgacctaccgattgagaaatatgtggttcaacctcaaaaggtagctcattcggataaagtttctcaaactcctgacgataaactttgtcaaaatcaagttcttttgacactcgttcataatattttttcgccaacatacgagcatatttttccctttcctcagcagttcgtgcttcgatacctaaagcagttaacggatctagatttggcgaccacatacctcgctcacctttcattaattcggtataacgactccattcttcaacggtcaatccccattctttagcctgttttaggctatcacttaattgtgattgttgatgttggctttgtttctgcaaagtcgattgtgagctacttacggtctctgtttgcatattttgagccagagtaggtaatgcaaaggacaataaaagaggtagtactgccaacggtatagctttacggcataaattaaacttcattgatatttccctcattattcctcaatgacctcggttttaattgttgtcgttgtaacggcaacagcaggtttatgagggttttggaatgaactttcccgagctttaaagcaaatcgtacgggatatatcattaagagttagttcataagcgggacctgcaatcatttgtagagcttcatataatttcatcggaccgaattggtaatgaacttttggaagaggtcgggtaaaaagtgtttgaaccgcattaccttgttctccgataggtggataacacaaatctaaacccgtattagttaatgtagaacgcaaaccttgctggacattcgcagtaaaacgatttttaggattggagactttgactgatacgacttgttcaagcagatatttttgaccttcctccggagcaatactgattaaggtgtagcgtccgtcacgtaccacttcggtattcgaggtagtctgttcttggtaaatatctttggacacgatacggtcttgtggaggtaattgttgcatttgaggtgttagcaatgaatcaggcataggtgtgatttcatcactattttgagctgtatcctgttgatgaacacaaccacttaagccaagcataaaaacagtcattaaggatatttttgttttcatttaatctctccaagtatgaaaggaatctagaccaactatggcgaagtcattgctgattttgaatgatttattctgttgttgattgagagaataaaaaaacgccatcattagacggcgtttgaaaacacaataatgtgctgtgttaatcggatttctccttagtattcataagaaaataagattgttgtacagctacgatcagcttctgtgatgatataaagactttcatcatctacatcgtagcgagctacaattctccctccgtatttcattgcttcctgattcgctaatttatcttcctcacacaaattgccccaatcaccataacagtaacgattaagcaattcaaccaaggcattttgattgaaacattcagcaacagcacgagttgtacatactcgaccaagttcaaacgtcatacatttctcctaaataaaatacggggaaatgtcacccattaggggagtatttccccaagtgggtggactaagactgcggcaagagtcgtttttagtaaaaatttgcaaaaaattaggcagctaatttagccggcgtcatttctttacgaatcttgtctaacatttcattccaatcatctatatcacagattctttggcgattaatgtaaaaatgcgtgtctattgcattgatatagtagtcaaattcaactaaatctgaatcttgctcaatatctaattcagtacagaatcgttgaattaagcgagagatgacaagctcctgatacagattaccgaaatgtggtacagtttcaaattctttggcaacaagccaaaagtcttcaatactgacaatatcgctatattcttctaagatggcttcccattgtcctaaatagcaagagatatcatcaaagtcaaaaaaggaatcttccattatgtttctccaagttttaaataaaaagtggggaaacatacctaccgagaatgtttcccgatagggtgtatagtcaatattagcgataaatatcaccgctcactgtgttaattttacctaaaatagatttacaatgaatgtcaccactcacagttttcacattcgaggttacattaccatccactgtgacatcaccactgacagttgaaacagatttggcatcgcctgttacacgaacattttctgaacctgcattgaggttggttacattgccaaatacttcaatgttgatagtcggagagggttctaatgcaattgtttgtccatcaacaattaatacattattgccggcagccattgagatataacctttatttatcccaacaactgtttgcactgtactattaatgatttgaacgctgttgatctctttgcctttagagtcaaagacttgtttaccgttgatataaataccttgtcgattcatataataatcctctttgtattagatgttaaaatgctcgatagaatacgatattaccattggaaatttcgttgcgagcagcctgtacaaacgtagttaattttgctaaagcaggtgtattagtttgctctaatcctactcgctctaacatatctagatcttctatgttcaataccaccgtagcatctttccagaatgtctcaataggttgatagtattccggttccgatgaggctttaatttcttttttgaagaaatgaaaagccatctcgttgtgaactaagaaaatccctctatcatcggcttcagtccaacggaaaaactccttggaatgttcaattaactgaatatctgtaccataaatggggttatcccaatcagacacaatgttatattcacgctctaagcctaacgaattaaaacgttcaagagagattgaatacgctctagcaagccaagaacattgagcccaagatttttcagggattacctgtgccggattttttccgaaccaatagcaatcccaatctaggtaaatccaatccttttcctctatgcttttgtcaaaaccaataatagtaaagccttgatcaagccatttaccatagccgttctgaacaaagacaacatcgccaacaataccatcaaaatggcgaccattaaggactgttggtgataatgttttgacaaattgttgaagtgagttcatcgtgtttctcctaaaattgtaaaataaaggaaaacacaccgcagggagtgtttccctacgggacataaagtaaagcccaacataaattgtcgggcttgggtaaaattactcagattgctcatctgcttttggtttttcttgatagacgatttccccatcaattttaatcattttgatgcggattaagcgacctttaagagacactccagtatcgccttttttgtgatatttactgtcacttgaataagtgaaagtatcgaaccacaaatcagccattacaaatgatacaagcacttttttctcttcagagaccgctttttggcattttttgatgagtgtttcggtttctttaccgactacattcatatcaaaatatctgtactctggtgagtcagattcgccaacaagagctgcaacacgacaagcataaaaaggatttccttttttatgctctactaaacgaatatcgtttaaatagccaatgccggtagtatgtagattgaagtaatttttttgagtagaagtttgagttgtcatagtttgtttctccaaatgtaaaaaagcggagaaacatccttacccaacacgggaaaaatgttccccgcaaggtggaagtaaaatggaatctcaatgaatattcactgaaatgatagggattgagttggcattcctgcaaatttacagagttccctttcagaatgctgggagacattttggcaataactcaactacctctaaggatagccgtcgcttctcaggagttatgcgacttattaagtgctgttatatacagcgtcttaaattgaggataatttagccatattgaatcataaagttaattgagaattgaattttgattttagagaattggaaatgacaacaccgttgataaatcacttaccaacggtgttgtacttttgaagaataaatgaaatttaagttagaccaatataagttactatattgaaaatagcagcaccttcgtgacaatgttgatattttcgttcgtaatttacccgattaccttgtggtctttaatcggcatatctgtggcatcatcgaggacacaaacggcaccctttattcacctgtgggctcaggctcagaatagttagcagtaattgcaacgtcataatccccccaatcgggtaatattatgacgttgcaatcacgatttagacaattacaacagactaatgtggctggcattatccatttaatgtttagttggcattcccacaaagtggagttccctctcagaatgctgggagacattttggctggtgtagattgataaccgacaatctacaaaacgggttctttgttccttgataataccataatctacttgaatttataactggcttcttaatttattcagttgatcgagtacatttaaattactacttttcttagcagatttatttgaagctgattttacctttttatcagcctctttatgttggcaatctggataaccagtacatccccagaatgttcccttagcgtgattgatttttctcattggcttaccacattctgaacattttcggatttcaatattcccaagtgacattccctgttgcatacaactgccgataagttgttttacaaatgcttcttgcttttgcataaatgcatcaagtgtcatactaccttcggcaatctgattgagggcttgttcccataatgccgttaaaccgggatttttcagtaagtccggcaaactatcaattaaggcaacggcttctgctgaggcaaccagtgattttttcttcttaaggagaaatcctttgtcaattaggccttgaattaatccggcacgggttgcttctgtgcctaaaccttccgtttcacgtaagcgttgtttgagtcttgggtcagtcacaaagcgagcggcatttttcattgcatcgagtaatgtcccctctgtatagtgtgcgggaggtttagtttgcaatgttcggacttcagaatgagtgacattgcattgctgatttttagtcaatacaggtaatccttgtttctcatcatcattaccagtttcctcatccacatttttgccaaacaagatacgccagccttgagcaacgatgacatttccccgagcaaccagagtgtgcccactagattgcagagtggcaacggttttatccatttccaagtgcggtaagaattgagcaagatatcggcggcgaatgagatcatagaccttcatttcctcctcactcaatttacttaaatcagcttttttaatggttgggataataccgtggtgagcggtaatttttttatcgtcccacgcccgacttttttgtcgcaaatttaatttaggcaagagagtttgtagccctgaatcagaggcaactaatgagcggattacgttaggaacatcagaaaattgtgattctggcagataaccacagtctgtacggggataagtcgtgattttatgctcttcgtaaagggattgtgcgatatccaacacctgctgagccccaaagccaaacaagcggttacattcgccttgtaaatcacttaatgcgtagagtaacggtggagattttttctctcgtttagtttcaaccgtcaccactttggctaagcctgtttgtttaatttgagcttcggcttgttgtatgacacgactatcaaggcaaagtccggactcatccaaatactgttcaggtactgcaagcccggcaacgaaagtttcaccagaggttgttgtcagctgaaccgctaacgcataatgagatttaggcacgaaattagcaatttctctatctcgattaaccacaagagttaatgttggactttgtactcgaccaacgctcaatggcttaccggaatagccttttgcttgagccattaaggtaaataaacgggagaagttcattccaatcaaccagtccgagcggctacgtcccataccggcgtagtaaagagcctcggtttctttacctgatttgagtgtttgaagagcctttcgaatactggcatcatccagagctgatagccagcaacgttggatttgacctcggtatccagctaaatctaacagctcacgagcaatcatctcaccttctcgatcagcatcggtcgcaatgaccacggaggttgcttttttgataagccctattacaacagaatattgcttcttagactcttttttcggtgtcattttccactgagcaggaataatgggtaatgtttcaaatgcccagcgtttccacgcttcatcataatcttccggctgatattgctcaacgagatgcccgaacccccaagtgacaataatagatttatccgcagtcgccagcaagccttcaccttttgaagtagcacccaatacgccggcaagatctcgagcttgagatggcttttcacaaataaataatttcatattatttcctaaaatgaatacagataggcaaatagtaatgtgctgattaaatagcattcaacgacttattgtctcgtaggatgtaataatttgagaaataaggacataaaaaatcccagtgtttccactgggaagaggttctaggagcaatatgagttattattttaatgtattaagtaaacgctgttttgcactatcgagccatctagcactaccagttgctttccattcaacattcacctgatttttactgcctttttcaatgataacttccaagtagttttcacctaagtgtaccccatcagtatctacatcagattcaaaatagccggaaacatggtaaaaagtaccttgtaccgtatgataaactttacgggagtcactatcagcattcgttgggcggaagccaaattcccgacgaactttcaggaatacatcatcaatattccgcttcaactgcaatgtgccggaatcttgataaacgtacttaccatttcgggttttagtataaacttgtcgcccattatgctgttcaacagagccgtctttagagccatagagcgtctgattcatttgcccggcccaatccccaaccttatcgttaattgctgagagttcagcacagcctgaaattagcattgtagaaacaagaaataaactatatttgatgtaacgcatagaattctccttacaagcgggttatctgcgttcattttttgcaaaagtgcggttaaaatctacttaaaactcttttacttacaaagagaaaaaatattatagctttctgtcacacagtagaccatttagatcgggtctgcttagttgtgagattgttaatatcgcagagataagttctaggcaatgttcacagctatggaaaatatgagtttgagatgacatatgggatatacgcacattttcccagtcatctgggtatacacatccgtgaatttcagtcaagtattgcttgatatgctcttctgtggcttgttcaacccagagctctagctcagtttgatactggtgtaatattttccatcgagttggagggaaattcatatatttatcctctatcaaagttatttttgcaattatttcatcaatgaagagagttaagaagtatttttattactcactatatggagagatatgttatgtggaaaaaaattaggattgattttactgatacagtgaaatgtcaattttgcagtagaatgattacatcaggcaaagctattgttgttcaaaatgaacttggcaatatctctttttcaggaccgtcttgtgctcaaaataagaacggtcagaatgtagtcaatcctaaagagaaaatagttgatatcacaaagggatgtttacttcatgagccaacaacaaatgataaaacggataagcaagtagatgttgagcaagataatttcacatccatacacgatgacgaagtacataattatttggacaataatgctgttaatgcatacctgaccttaagatttgaaaaactatcgcatttaacctcgattataaaatctcaaaagttaaatgaaatctatcataactatgaacttacagggcaaatatctcaaaaagatgaaagttacataagagtgattatgtatggtgaggcatatcctttgtatacataccaaaacttacaagctgtttatgctgctgaatattggcttcaatcatttattcagcataatccagagaatgacttaaattttatacaagacacattaaatcagctcagaagaaagctaacattaactgaaaaacagattatgggcataaataattggtttaagaattctgatggaaaaatggtgaaattaaagacaaatgcttttgtaagagggaaatagttaacataattgtggtggccacttattttgttacgtaggcccgacgtaagactggttttaaaagactctttcctattatttgcttgcttattttgacaaattcaagttatatgtaattcaaaacggttgtttctatatcacttaggaatgtaaattataaaattcttttaaatcaattaattaaatattaagtttcccagattgaagtatgagtacgtaaaaataaagtataaaaagactaaatttcagattttatttttacacaatgtacttactataaaataccaaacagataatatttgtccataaattcattgagttgattatgccatttttacacttattgactatagcgttttgcctaatcatctgtctgattccagttttacccttttcccaatatctttcaatttcgataaatcttccactaatcttgctacatattcaagaaaaagtgcgatcgtttttcaaaggattttatgaaaacgaccgctgtaagaaagaatttttatttacgactttttcaggtatctgaaaactatttcgcttctgaaaaattcaaaattgcttcaggcaaacgcaagccgacaatttcaatggcttctaattcttggcggaattgcgccaattcttcttcggtaaatttcacatcgtctgcgcctaaattatccaacaaatgacgggctttgctcgtcccaggaattggcgcgataaacgctttctgtgccattagccaggccaaagaaagctgtgcaggcgtacaaagtttgcgttttgcccatttttgcacaagctggattaacttcacattttgttgcatcgcttcgggtgtaaagcgtgggataataccacgcaaatctttgcttggatcagcctcaaaacggctgttctcgtccacataaccagccaatgctcccattgccagcggcgaccaaggcacaaacccaatccctaattcttcacaaacgagaatgacatctttttcacgaccacggaaaaacaacgagtattcgctttgtacggcggttaaaggctgaatagcgtgtgccttgcgaatggttttctcgcctgcttccgacaagccccaattcaaaactttgccttgtttcattaaatctttaatagcgccagccacctcttcaatcggcacattgggatcaacacggtgttgatagagtaagtcaatacggtcggtttgtaagcgttttatcgtaccgactattactgaatggcgtggttgggtagatatcgcatcaattgcatcactattattagctacctttcctatttttattattttactcatggaattaaaagttattcataaaaatctcgtggatagtgcaaaaattaaattacatgcggtttatcttgtgattttcttatttgtgagtcactttgctatgatctttggcatggcagatcctatttcagcaggctatcaacccactacaccagcaatgactcattcaatgcaaatggatgctaaacaaataacagaaatgcacaaccaaatgatgacgggcgaaataacgcctgaagaaatgatgaagatgcatcaagaaatgaaccctaatatgaatatgccgaatactcaaggtggtcattcagaacatcataaataataattctgatcacattttaaaaaataatagtggatggtacgttggcatatctctactacaagcagtaggattttgagaaaaattttcaaatgatagaattttttcagattacttgaccttaaccctaggttaagctttaaaatgatgtccattcaatctcaataaaaaataaggacatcttatgaaattacataaattcacccgctcattgttgcttttaagtttaggcataaccgcttttgctcaagcacaaacactttctatggaagtgtggaaaagcccgacttgtggctgttgtaatgaatggatcagctatatgcagaaaaacggttttgaggttaaagtcaacgaaacaggcaattatgatgctcataagcgctttaacattaaatatgaacatgcttcttgccacacagccgtgattgatggctatgtgattgaaggacatgtacctgctgaggatatcaaacgtttactcgcagaaaaacccgatgcaataggcttgtctgcaccgggaatgccaattggttcaccaggtatggacggtgaagcatacggcggacgcaaagatccttatgatgttgttttgattaagaaaaacggtgaaagtgaagtgtttaaatcctataaccaataggggggggggaaagaatgaaacgtcgagattttttacgttatggaattggaattagcttagccagtagctcgctttatagcctcgcgaatatgatgaaccacgcacaacatggcaatatggcgatgatgcattcagtacctactggcctaatgccaactgaggcaatgccttcaggtttatcgcttaatgggatattaccaaaacttgctaatcaatcgactcaagctggactgttcaaagccactttaaaagcagagccaattaaaattcgcctcgcagacaataaagaaacggaattttgggcttataacggacaactaccagggccacaaattgaagtatttgaaggagataccgtagaaattgaatttatcaatcacctaccacaaccctcaacagtacattggcacggcttagatgtaccaaatgaggcggatggtaacccgatggatatggttgaaccgcaagggaaaaaagtctatcgctttacgctacctcaaggcagtgctgggacatattggtaccaccctcatccacatgaccatgtttccgaacaagtctataaaggcttagcaggcactttcgttgttaaagcgaaaaatgatccgcttgcacaccttcctgaacaacattgggtgatttccgatctgcgtttaaatgccgatggcaccattccagcaaacacgatgttagattggatgaacggtcgtgagggtgaatttgtgttaatcaacggtcaatatcagccccagattcaagtgaaaacgaatgaacgaatccgtctttggaatgccactagcgctcgttattttcgtttaaacattccaggggtgaaatggattgtggtgggtaccgaaggtggtttacttgaaaaacctcgctcgcctgttgatgaactgctacttacaccagccgaacgcgttgaagtgattatggtgggtgaaacgcaaggaacagccaatttacaaagcggttattatgatcgccgtaagatgatggttcaagaacagcctaaagatctcactttagccacaattcaggtgaaatcagaacctgttcagttacctgaaagcttaaggtccttgcctaactgggatgagccaaagcaggttcgccaaattcgctttagtgaaaaaatgatgaaccatacgaatatgccaatgatgaatcacggtacacatcacgctactacaacactaacggacaaccctattccaccaatgatgaatggtatgttcttaatcaacggtcaaacctttgatatgaaccgtattgattttgttaccaaattgaatgaagtggaacagtgggaaatcttcaatgaaagccatatggatcatccattccatttacacggcactcaatttgaagtaattcaacatacgttaaacggtaaaacctttaagccagaaggcagagcgttaaaagatgtggttaatttacgcccttatgaaaaagtgattattcgctttaagcaaggacatactgggttgaaaatgtaccattgccatattttagaacatgaaaatctcggtatgatggggatgtttaaagtggaatagtggtatctaactataaaaatagagggatttcgtcataaaaaatctgcaccttaatcagttggtttttagtccaacttttggggtgcagatcagacgctcactttgtcgccgatttgaaattcgccagcgtcatcgcccactgccacgaccacgcctgcccctgcataacccaaagtcgcagggaacacagggtcaatcacatacgccccttcccgatacatcatctcggcacggtttagtcccaatgcacggcacggtttttaaacattttcattatagttttccttatcaaaatgggatttggcaaacattgggcaaacctaagcccgcccaatgtttttagttaatcaattacttgcaatcacaatcgccacaagtgcagttttgacaaatgcacagctcgccattttggcagttgcattttggattgcaattttgccctgtgcaagattggcaaccgcagtgggcgtttgggtttttgatgatgtcgttcataacaattctccaaattaaaggttgattatcaaaacaaaaaccgtttttaagccactaaaaacattgcttttttgttttgatgagcgtatcataaaacctaaccttgcgttagggtcaaggattatttttgcggattgacaattttttacaaacgccaaaacaaggagcaacaatgaacatcggtcaagcgtccaaagccacagggctgtccatcaagcaaatccgtgattatgaaaaagtcggtttgttatcaaacacttcacgcagtgcatcaggctatcgtatttatggcaatgatacgcttgaccgcctaaaattcatcgccaaagcaaggggcgtgggcttttcgcttgcccaaattggcgagcttttggcactgcaagacaatccacaccgcaaaagctgtgaagtcaaagcgttggcaaatatgcacattgaatttttgacccagaaaatcgaagaactgacacagatgaaagccaccttgcaggcgtggagcgacgcctgcaccggcgacaacgcccccgactgcccgattttaaaaggcttggcggagagcggtgaggataagggctgacaaagttttttggcggttttttcaggcagggttaattcaggcaggtttaatttaagaaggccgtcttaaaaaacacaatttgccgttttaccgctgttttttaccgcaagaagcacttatcggtggtaaaaaacagcggtttttgacgctttgatgagaaaaattcagcctgaaaactgatgagcgttttcaggctggtttttttgccgagcgttcaaggataactttggtacacgctgtgcgtgccgtttttgcccagcagcagcacatcgtaggggtcttttcggccgccgtacgcttcaccgtccattcccggcgagccaatgggcattgcgggcacggcgatgccgacggcgtcggggcgttcggcaagcaggcgtttgacttctgatgcgggcgtgtgcccttcgacggcgtagccgtcaatcacggcggtgtggcaggagccgtatttgggcgatatgcccatttgtgtgcggatttggctgttgccggtgtcgtggattttcacgctaaaaccgttgtcctgcatatgcttgacccattcgccgcagcagccgcaacttgggcttttgtacacttccagtacgggtttggcctctgcgggggcggggttggcgagcatccagcctacgcctgccacgcttgccaagacggctgatagggccaaggttttgccaaaaaaggatttgttcattgttttgcctcgtcgtgggttaagtggtttggggatttttcaggcaggcttaatcaagcaaggccgtctgaaaaagcggttcggggtttatttcacttgcaacattgccatcattcccagattttcgtgttccaagatatggcagtggaacattttgagacccttgtttccttggataaagcggatgacggcggtttcgcccgggcgcaggttgaccgtgtctttgcgggcgcggtaaggcgcgggggcggtgttgccgttcaggctggtttgcagcacttcaaactgcgtgccgtgcaggtggaaggggtgatccatatggctttggttggccagcgtccattcttcgacatcgccttcgttgccgacaaagtccacgcgcttcatatcgaaggttttgccgttgaccaaaaacacgcctaccatatcttggggaatggtgttttgcatcgcgcccgccatttcacccgccattgcgccgtgatccattccctgcataccgccttggctttgcgtgttttgcatcggcttcatttgttcgctgaacaccacttcacgcttgaccacaggcgcaggcagcgcaggcagtgtgcgcaaggcggcaggcagggcggcatcggcgggggtgaattgcacttcgcccaggttcaggtcggcggctttttcctgcaccatcattttgcggcggtcgtagtacaggctggtgagttcggccgtggtctgcgcctgaccgacggcgaacacttccacccgctcggcgggggctaaaaacagctcgtcggcgggggcaagcggtttttccaagaggccgccgtcggtgccgaccacaatccactgcacacctttgattttcaggcgcaggtagcgggcgctggtggcgttccagatacgcaggcgctcgttgccggagagcttgattttcgggcggtattgcccgttaatcagcacgaattcgccttcacgcccgttcatccagtcgagcattgtgttgggcggaatgctgccgtcttcattcaggcgcaagttggaaatcagccagtactgttcgctgtgggcgagcacatcgtttttggctttgacgatgagcgtaccggccagccctttgtagacctgctcggaaacataattgtgcgggtgcgggtgataccagtaagtgccggcgctgccctcgggcaggatgaagcggtaggttttgctctgccccggctctatcgggtcttgtgggttaccgtcggcgtcgttgggcacatccagcccgtgccagtgcacggtggtgggctgcggcaggcggttggttacggtgatttccaccgtatcgccctcgtacacttcaatctgcggcccgggcagctgcccgttatacgcccaaaactcggtttctttgccgcccgccattgtgattttcaccggcgcggccgtaatggctgcctgaaacacgcccgcctgcgatgaagcgttggcaagcctaggcaaatctttaagcggctggcccgaaggcatcatttcagacggcatcagttttcccgttccctgcatattgcccataccgcccatcgtgccggacgccatttggtgcccttggccgcccatatccataggctgcccgttcattccgaagcgcgacaaggcataccaagacgcgcctgccgcaccgatgccgatgccgtagagtaaaaattttctgcgatccattatttgtctcctgtgtcaagattggggcggtgtgttatcttcaccgcttcggttttggcattgtgcgtgccgtggctgccgtgtccgccgtgcataaacaggtgcatcagggggcagagcatcaacagggcgaagggcaaaagtgcgggcttggcaaaggcgatgacggcgaaggcggcagccgccaataccaacagggcttttttgttttttgccagtttgcttagggtgttcatcgtcggtctccttaaaggtttgggtgaaacggttttttgaaaacttgggctcagtgtaagcccttaccctacgttagggtcaagggcttttttgtgggcgccgggtaaagttttcttgccgtttctttacgctcatagcctgctgttgttcagccgcagagcgttgccgaccacggatgccgagcttaggctcatcgccagtgcggcaatcatcggcgagagcagccagccggtaaaggggtacagcacgccggcggcaacgggaacccccaggccgttgtataagaaggcaaataacaggttttccttcatattgcgcacggtggcctcagacaatttgcgtgcggtggcaataccccgcaaatcgcctttgaccagcgtgatttgcgcactgctcattgccacatcggtgccggtacccattgcgatgccgacatcggctttggccagtgcgggggcatcgttgatgccgtcgcctgccattgcgaccacccgcccttcgttctgaagccgctcgatcagtgccagtttgtcggcgggcttgacttcaccgtgcacttcgttgatgcccagttttgcgcccacggcgtttgccgtggtcaatccgtcgccggttgccataatgatgcgcaggccggctgctttgagcgaggccaatgcttcgggggtgctgtcttttacaggatcggagacggcaagcagtcccgcaagatgtccgtccgcagccagatatatcacgctggcaccttcactgcgcagggattcggcctgctcgaacagtggttcgacgctaagcccgttctgctgcataaacgccgtgttgcccagtgccagcgcacgcccttcaaccacgccgctcacgccgatgccgctgcctgaatcaaactgttcgggtttgctcagcttcagctgttgtgcccgtgcggcctgcacaatggcgtcggccagcgggtgttcgctgccctgatccaagctggcggccaaacgcagcacttcctcggcggaaaagcctgctgccgcaacggcacggtcaaaggcgggtcggccttcggtgagtgtgccggttttatcaatcaccaaagtgtctactcgccgcaagttttcgatagcggcggcatcacggaacaatatgcccctgcctgccccgcgtcctgtggcgaccatcaccgacatcggcgtggccagtcccagtgcacaggggcaggcgataatcaagaccgcaacggcgttgatcaacccgaacacccaagacggttgcgggccgaacacgccccagacaaagaaagtggcaacggcgacggcgacaaccgccagtacgaaatagcctgccaccccgtcggccatacgctgcatcggtgctttggagcgctgcgcctgggccaccatctggacaatctgcgaaagcacggtttccgaaccgatgcgctcggagcggatgacgagcgcaccgccggtgttgagcgtggcgccgatgactttgtcgccggtggctttgcgcaccggcagcggctcgccggtcagcatcgattcatctaccgagcttgcgccctcaaccaccacgccatcgacaggcactttttcgccggggcgcacacgcagaaggtcgccgatgtggatgtggctgagcggcacatcttcttcagcaccgcccgggtcgatacgccgtgcggttttgggcgccagtccgagcagggtcttgattgccgccgaagtctgcgaccgggctttgagttcgagcatctggccgagcaaggtcagcgagatgatgacggccgccgcctcaaaatacacgccgacccgccccatcgatacaaacgatgccggaaagatgccgggtgcagcggtggcaacaacgctgtaaacgaaggctgcacccgttcccagtgcaatcagcgtccacatattgggactacggtttgccagcgactgccaaccccgtgagaaaaacggcagccccgcccacagcacgatcggcagcgacagcaccagctctacccagctttgtgcggccatatccatcaggttcagacgctcgccgaacatcgccagcaccagcactgccgccgtcaggggcagcgtgtaccaaaagcgtcgggaaaaatcacgcagctccggattgtcgtcgtccaattcaggcatcagcggctccaatgccataccgcaaagagggcagttgccggggcggtcttgccggatttccggatgcatcgggcaggtgtagcccgaagcagccgctgcatcggacggtgtctgcacagggcggtgctgtccgtgtccgtgtcggcactcgtggtgtttgggtggtttgtgtgtttcttgcttcatcacaatttctcctgttgggttcatagggtcatcaccggtcgtttaccgaaaaagcaggtacggattgggccggtcagaatgacggtttttttcaggctgcctgcaaataccgatgccgtctgaaaaagcagaaggttcagaacatcgcttgccgatgtgtccgacaagtcggcatcatcatttccttggggcttgttttaaaggttgcctgaaaaccccaaatgccgtctgaaaaagccttaaacctgttttcagacgacctcaaaagcaccgctttatcaaaagcggtgtttttgccttattgcccctactgttttaaccagtcttgcatcagcttgatttcaggttcttgggctttgatgatgtcttgagcgagctttttcattttttcgtctttgccgaactgtaattgcacttttgccatctcgaccgccccttgatgatgcggaatcattgctttggcaaaggcaacatcagggtttggctcattgattgccgccatcatcgcctcgtggtgcgccttgcctgcggcataggccttggcgtgcggggcttgcgggttttgggttgcggtatctttacccgccagccaagcgttcatcaggtcgatttcactttgttgtccatcaataatcgcttgggcaagttttctcattgtttcgtctttgccaaattcaagctgtacttttgccatctcaactgctccgatatggtgcggaatcatacctttggcaaaagcggtatcagcatcagcaagattgcccgctttgctcatctcatcgcccatcttgttcatcattgcaagataggcttgggtatggggcggagcattttgagtgtccatcgccatagcagagtggttcatatgggcgtggttcatctctgcgtgcccgttttggttatttgggctgtcgtgggtggtttgggtgtggttattgtcgcctaccatcgagtgcgtcggcacttcgtttttgccgtcggcacaagcggttaaagtcgccaaaataagggcaagggcagataattgtacggcacggtttttaaacattttcattacagttttccttatcaaaatgggatttggcaaacattgggcaaacataagtccgcccaatgtttttagctaatcaattacttgcaatcacaatcgccacaagtgcagttttgacaaatgcacggctcgccattttggcagttgcattttggattgcaattttgccctgtgcaagattggcaaccgcagtgggcgtttgggtttttgatgatgtcgttcataacaattctccaaattaaaggttgattatcaaaacaaaaaccgtttttaaacccattaataaaaaaatgccatttaaaacggtcacttttgcacaagcaacaaccaatgatggtcaatccttattagcggttaatgacttatttattggccctaaaagccacacttccgcacagtatattttgcaatggaatggcgctgaagaagtgcaatcttcatcaggcattattgtatcaacaggattgggatcaacggggtggtttcaatctattcttgctggtgcgatggcaattacaggagaagcttcgcaccctctattacaaggctttagctggagtgatcgaaagctacaatttagtgtaagagagccatttccaagtagaacaacaggtgttgcactgacttttggcactattgagcctgactcaccactgcaattaggatctttgatgccagagaatggcgtaattttctctgatggcatcgaagatgactatttacaatttaatgcaggttgtattgctcacattggtatcgctgacatacaagggcaactaattagccaaaaagggcgtcagcgaatttagatttatttagcgctctttaatactgtttcaagtccagagatcatcacatcaaggacaaacaaaaatgcagcatcaccattatcactatccataattgcaacggcttgggttaataatggcggataggcaacagtatccgtctctactttttcacgctctttttggctttcttgatgctcttgagtttccagtacggagcctaatgtaaaatgcgcaatagagcttaatgcatacacggcttgagatagactaaacccagcatcacacaaaaactgtagttgctgttctgatgtctcaaattgactttcagaggggcgtgttcccgcatgaattttgccaccatcacgatacattaataaggcttggcggaagcttttcgcgttatttcgcaaaaagtcctgccatgtttcattcggcaatggcaaaacatgatgatggtgcttttgcaaaatagtttctgctaatgcatctaacaaagcgcgtttattttttacatgccaatacaatgtgggttgttccacacctattttttgcgccagcttacgcgttgttaatccttcaataccaacttcattaagtaaaatcaacgcattatcaataacttgttctttatctagctttgccattacctacctcaaaataaaatagccttgacaatctatcactgatagagatatattacacccactctatcactgatagatttttaggatctcaatgaataaatcaattattattatactgctgatcaccgtattagatgccattggtatcgggcttatcatgccagtactccctactctattaaatgaatttgtcagtgaaaattcactggcaacccattacggtgtgctattagcgctctatgctaccatgcaggttatttttgctcctattctaggacgactgtctgataaatacggcagaaaacccatcttgctgttttcccttttaggcgcggcactcgactatcttttaatggcattctcaaccacactttggatgctctatattgggcgcatcattgcggggatcacaggcgcaacaggtgccgtatgtgcatcagcgatgagtgatgtgactcccgctaaaaatcgaactcgctattttggtttcttaggtggtgcttttggtgttggccttattatcggcccaatgctagggggattattaggtgatatcagtgctcatatgccatttatttttgccgctatttcacactcgatattattaatactctctttgctctttttccgagaaacacaaaaaagagaagcgcttgttgccaataggacacctgaaaaccaaactgcctcaaatacagtcactgttttttttaagaaaagcctctacttttggttagcaacctattttattatccagcttatcgggcaaattcctgccaccatctgggtgctgtttacacaatatcgttttgattggaacacaacttctatcggtatgtctttggcggttctgggtgtattacatattttctttcaggcgattgtcgctgggaaattggcacaaaaatggggcgaaaaaaccaccattatgatcagtatgtctattgatatgatgggctgtttattattagcgtggataggccacgtttgggtcatcttaccagcattaatttgcttagcggcaggaggtatggggcaacccgcattacaaggttatttatcaaaatctgtcgatgataatgcgcaagggaaattacaaggtactctggtgagcctaaccaatattaccgggatcattggtccccttttatttgcctttatttatagttatagcgtcgcttattgggatggtctgttatggctgatgggggcaatactttatgctatgttgcttattaccgcttattttcaccaaagaaaaaccacacctaaagctgttatttcaaccccttaatactagaaattataaagatcataaaagtcctgtccgctcttaataacgttgataggactttatttttatcgcttgaattttcccccaagcggtgttttttttaatgcccacccattttggacagcgtattcatcattatcacacctgccaaaatcaagccaatgctcgcaattccccaaaaatcgaccttttcgccaaacaccaccacgcccacaatcgccgtcaaaaccaagcccacgccagaccaaatcgcatacgccattcccaaaggaatgctttttaacgccaatgacagcaaatagaacgccaagccaaaacccagcacaaaaccaatagatggcaaaggcttggtaaagccttgcgatagttttaacatcgttgagccaaacacttcgctaacaatggcaatgcccaataatacagaccaatgcatcataagctcccaatttttatcaacgccatttggcgtagttactgatttatacgattgatgaaagtgttcatttgctcattaaataaccgctccaaaatggcaaattcatcaattaacttttctagttgctcaataccaaaactttgggcggtgttattttctattcccaataatggagcgatgatacttttggcataattttcgcctgtgtcggttaggcttaataatttggctcgtttgtcgctgggattatcctgcatttctacaaaagattgattgataagatttttgcaaatggtatgtaccgtttgtttgggcaatgcccattcatcacaaatgtctttttgggttaaggattttttgtgataaaaactgtataaaataaacatttcgcttaatagcacggtttgggttttggcatagctttcaaaggtgctatcaaggcttgcggtgagttcggcaaggcgggcgagttgggtttggttcattattatctacctacaaaaatcattattgacttaaacataaaataaggattgccaataatgcaggcaagccttgttttattaaaatggctttattggaagtataagcaccccaaagccctgcaataagcacaaaacttaaaaataaaatactcgcttgaaattgtactatttgcggagcaataaaatacgcccacaataatccagttgccaaaaaaccattataaagcccttgattgctaaataaagtttgtacctgtttttgtgccataaaatcataagataaaccaaaactttttttggcaagtcggcttggtatcataaacatttctaaaatcataataaaaaaatgttccaatatgaccaccaaaaccaaaaatgttgcaagaaatttcataattgaccttatcatagacattgcaaaaatatttacgagccaatcatcaatatcagtgcaaatgaattaaattgggaaaattaaaattagtcctaaaaattactaatttcacatattatagtcgattttaggactaatagcaaggtttttgacagttttttggggcttaaaacaaaaaacaccgcttttatttctgcaagcggtgtttttattatccactattccaccccttcccaccatttttcaaacttgggattgtcatcaaggtagaatacttcgcctattttaggagtaaaaagcggtaaattttcttgttgggcggattggcttaataataccatcggttcattccaagcgtgtttggcaaggataaatttactattatgcaccgccaataattttttgggatttaaatctttgaccgcttgaatgaaatcgttaggcaaaaaatgaatattcgcccagtctttatcatattgcccattttccataatcgccacatcaatattaggaaattgcttggcaatgtctttaaaaaacacatcataaccgctatcgccaccgatataaatggttttattgcccgcttgtaacataaatgatgcccacagcgtttgattttgttttaaagcacgccctgatgaatggcgagtgggcaaggcggtaatgtttaattcgcccaatttaatcgcctgataccaatccaattcaacaagctgattgggcgaaaatccccagcgttcaaaatgttcgccgttgccaagccctgtaattacttgcccaatcctatctttcattggtttaatcgtgtcataatccaaatggtcataatggtcgtgggtaataatcagataatccacttttggcatatcatcgggcgtataaatatccgcccctttaaatggttttcccccaaaaggcaggggcgttgccgataccaaaacagggtcaatcaaataagttttttgatttaaatgtagcaaataagacgaatgtccaagccaaacaaaataatctttatttttgggtaaagtatttaaatcggttttaatggacggtatgggcgattttggggcgacatttttatctttttcaaataaaaaacggtataaacctttgataatagaactctcgcctgtccaagtgggcgtgtcggataaattatgaaattgaccgtttttataatgtggtgaagtttgaattttggcaaggcgttcgcctgttgggtttgccccaaataagggtaattgcaaatacgccacgacaacaagcaccaaaacggtgatgatgattaaaaaaccgataaacatttttttcattaaattttctcaaaaattgactggctattctagcattttgggcggtgtgtttcttgcctaattggattaaaaatttgtctaattggataatttttcaggcagcctgaaaatattttgcaaaatttaaaaataaaaacaccgcttgaacatcaatccaaacggtgttttaaattaactgacttttaattccgcccaagcccttttgatgatttcttgactggcttgtaatgccaaaaatgccaaaacaaacgccacaattaaatcaggatattttgattgaaaaaaataaactgccatacccgccaaaattaccgccacattaccaatcgcatcgtttcgggaacacacccacacactgcggacattgctgtcgccatcacgaaattttaataatatcaacactgccgacacattgaccaataacgccaaaaatccgacaatgctcatttcagaataactgggcatttccccataaaacacacgataaatggtcgtcattaaaataaataaaccaaaaccgcccatcgttagccccttaaccatagatgctttggctcggtaacttaacgccattggcaaaacaatcaaacttatcaaataattggcactgtcgcccaagaaatccaaactgtccgacaacagcgaagttgaacccgatttaacccccatcacaatttccacaaaaaacattgataaatttaatatcaagacaatccacaaggcttttttgtacttgggcgattgatgaatgggctgatttgaaccacaacaattttggcacgccatttttttgctcctgttttaagatgaaatttgctatactataaactccgtagtcattacagggtcaagccaaaatgtcaaaattttttaaaataaaacaagccagtgaacaaacaggcgtacatttggaaaccattcgttattatgaaaaacaaggcttaatcgcccccacacatcaacaaaatggctatcgtgtgtttgatgaaaatcagttagaacaattacgctttattaaaacttgccgtaatatcggtttttctttaagtaacatcaaaacgctgttgcaattacaacaaacgcccaacaaacaatgcaatgaaatcaatgcacttgccgagcaacatttggcatatttggacgaacaaatcacagaactacaacaagttaaaacttttttaatgcaatttgtgggttgtgaaaataaaacggttgataagtgtcagattattcaaggtattaaagaaaaagaatagcggaatatttttcaggcagcctgaaacctttttccattatgggtttgattttgacggtggtgttgctgtttgcctttcaagcccaaaccattattgccaatcccttgattattttgctgattgccattcccttgctggcacagacttacggcatttttgtcttggctcacgttttggcaaaatagctcaaattaccacacgaaatttccgcccctgagtgcttgattggcacgagtaatttttttgaattggcggtggcgatttctttgttcggtttgcactcgggggtggcattggcaacggaggtcggtgtgctggtggaagtgcctgtgatgctctcgctagtgtggtggcttaatcggcaggtaaaataacgatgtgccgtctgaaacttatttttcagacggcatatttaccttaaaacaatcaaacctttaccaaaatcttcccaatctgtgcattgctttccatataacggtgagcttccgccatttcatcaaaagcaaaaactttgtcaatttctggttttaattgaccgcttgctaagccgtcaaacacgaattttttcgcttgagcgagtttttctggtacggtagtgatttcaaacaattcatagcctcgcacggttaagtgtttgcctaaaattgggaacacaggcacggcgatatcatcgtggcttaatgcaccgtagatgatgtatttgccgtcttgtgtcattgcgttgataatttttgctgcttctttgccacccacagggtcgaacactaaattcacgcctttgccgtttgtaatttctagtaatttagccgtaacgtcatcttctttggtggcaatcacaaaatccgcccctttctgtaaaagcacatcgcctttggcgtgcgtgcgagacagagcaatcacgtttgccccttgcattttggcgatttgaatggcggcaatgcctaccgagctggtcgctccgcccaatacaacaaaatcgcctttttgcaccttgccaaattcaatcaaaccgccgtatgcggttacaaacatcatccaacttgccgcagcttgatagaaataatatgtattctgaaagcgttgttagtctattatattgatgactaagagatacggcagaataaatatcaataaattgagtcctacctttcattaacacactttttttgtattgattacattcttttgcttttttacatttattctcatatgccgaataagagattctaattggttttctgttaagagtactttgttatgaattagatcactaataacaagattattctgtttttcccaattcattatccactgtatagttcccagcttatttctaattgtgtttactgcggattgattacgtagttccacagttacccataaggttgaataaaaatcaggaataccagttttaacattaaccaatataggaaaacgttctccatttgaaaaaaaggactgtttctaatctatacatattcatttaatttacaaaaatatcatatataaatactatcaaattaaagatgttgtgtcgaaattaatgtaaaaaaagagaacccttttaaaataaagggttctctatatttatatgggttttattttacagttttaaattatatgtaactcagaacggaatatcatcatcaaagttatccattggtaaatcttgtggatgtgttgcttttggagattggctcatagcttgatagttagattgttgtccatctacgctatttgtagcattacggctatctaacatttgtaatagttcaccttggatttcggttgtataacgctcttgcccgttttggtcttgccacttacgtgtccgtaattttccttcgatataaattttagagcctttacgtaggtactgaccacaaatttcagcataacggcgataaaaaacgatacgatgccattcagtgacttctcgacgttctccggtatttttatccgtccaactttcagaagttgccacactaatattagcaactgcttcaccattaggcatagtccgcatttcaggatcgttgccaagattaccgacaataatcactttattgattcctgccatcgtatttactccttcaataaattaagttagttctattaaacttgattcagcctaagaaaaaagtatttaattaaaatttggttagagtgaatttttcatttttacgtgtgcaatcacttattcctccgttgtaaaggctttttcttcgtgaaggtaaggggcttgtacccttacctttaaaaggccttttaatgcaggatttacaaactgcactttttcaggtattacaaacttgaatatgtcctaattaacggactgtttgttttaccacgtcagcccaccgtggttggcgtttacacacaaccaatataggagttattatatataaatttactacgaatttaagtctgatttcgcaacggcattatctacctctttcaacttttcagcacaatctgccaactgtcgcaaaatatgattaaacaccgaaatctgcatattaatcaaaatcctgtctttttctactgcgacaacttttttcctcacctccactgggacagacttatcatctacaatcggctgccaaactgtgccaccggttctggcattttgcatactacgccagcgtaaaaatgtaccgcctgaggatgaggccttatccttaatcatataaacagccaaaggtgaaagatcctgccgcacagactgcaccatactatcctgtgcagccataaaataagcccgagcttgagtgaactgttcttgcaaaagttcatagtctgagccagtgtcaaaatggctaaatagctgtttcagagaagtattcagcccagaatctttgactaattgccgataaatttcatcagagatgaggttcatatcactccttatttttgagattcatttgtctgtgccgtgatatgggtttctacggattgctcttcttcaacagtagtgttttgcttgatgaagggagcaaactcagcacgatgctcaccggtaagtacagcatctgagagtgtatagcccattcgttttatcgcagcttgatagcgagcattcttttcttgatagtcccgacgagtgattcctgaactcttataacgctcaacgatcccaaaacatttccggattaaccttgcaccagcttcaatccaatcttgagcttctgcacgattgataatcgcaatatgagctgccgtcattactgaacggcaaaggctatcaaaatcaccaagtaagtagagtaattgataccctagctgtgaattaacataaatcgggtaagaaatcggggaaatattggcacagcgttcaatagaaattccctccggcaacattttggcgtagagcgtgacaatgtcgttggtgagcttttggatttccttccgataattgatcacactttcttcaaattgaatcagataatcgtcagcataaggatcatcttctgatgcagcccgttgaatttgggttagcattgcaaagcaatttggtacgctgataatggaggattgagttactttgccttcctcattacgaatcattggtcgccccacccataatttatgggcatattgggtatgtaacgtaaaagtgatctcactacgaagtggaccaagttgaggatctaattgagtggtcatatatgctccttgtttatttgattattttttagtctttggaaaggggctttccattgtctgttttttaatctttgcagacactgcctacgctgtttattttttatccattgtgtacctggtacacactgattatttttcactcactattaagccccttaacagtgattgttttttaatcttattgtaaaagtaattcagctctaaacttctgcatacgactagccatttgctctctgtctgctgaagttaagaccggtttctcagtaggctgctcagtcagtttttgtatagaatgagcagaattattgttagcctgattctgtgagggaagattttttcctaattcaaaatagtagggtttaaattcaccctgcttcgcccgctggataagcgtatagagataacctttcggttttttcacatcctgcttttgaataatgcgttgttgtgcttccaacaaaatagcttggcataaaccgaggtctaatcccttcattgcctgtgcagtaagtttttgttcaagtgaagttaatgggatttcttgtggccaagtaatttcgctcggttccccagtacagtacttattaatatataaagtacggtactgtacatctgacttccctaatggaagtaagtctaaaatcaatgacttatcttcatttttagccctaactcccttattggaagtctggtttttagaggattttttcctgacttcctcatcaaaatccctaacttccatagtggaagttaggatgttttgttgaattttgcttaattcttgttctgtttgcgatggctgtttatctttcaccagctgctgttgctggtatatctgataacgactttgtaaacagtctaaatgagagacatagtgccatttggttttgtctgttattagactttcaacaatatgatttgccacaccattaataaggctatctttatgtttggtgcatttatctaaaaaagagagatagtcgctatttaattgaattgcatctaaaattggcacaggttcatcatgtaggatataaacattaccttgtacataacctcgctcatcacgcactgtttcacataaagtaagccagcgagtaagacggagtaaatagagtgtttgagtcacgactttttccgataatttagcctccgcataaggtctatcggataacattttgctgagcgtctcataagagggaaataatcctccttgaaaggcttgaacattgcacttaatgagctgccaagcaaactttgctcttggtgtaaggcagggatcttgtaataatcgagtagggactgtttcgtgttggttgccaaaaaatagcaatccatgctctgttggcttattcgtgctgctaaacattgtttctctccaccaggataaaagagtttttctcttgctattctctctcctatggctataatgcacgggacttctgcaaagtccttgtaattcataagatagagatacaagactcaatatcgaatgccccaaagctccaacttcggggcatttattttttacttatgttttgaataccattcggaaaccagtttccaaacaaccgttagattcatattgccttcctcagcaatcagacacagaagctctaatccttcttgtgaatctaggatttccattcgttgtttgtatctttgccaaatttcccaaatatgggtagattcttcatcacttgctgccgcttttcgtcccattttttcttcgataccgagtaattgacggcgagccgagacttcagaggttgataaaccaaaatactggtgcaacatttcaatagaggctccgagcaataatgctcggtcaataatttgtcgctgttgagtattggcttgtgcaatagccagtaatttccaaaaggtttcgtgattaatctccaccttagcaaaagagacaacggagttgctaatatccataatttcatcaatactgagattattgatcgcttttagttgctcctcagaaaatcccatttttagacaaggatggatatttccctctttaatattgagcagggcgttaccaatcaatgcttcatttacggtaatcggcttaatcattttctcctccttgttggcgaatatggcgactgacccgaatgagacggaaaattttgactaaggtaagatcatcaagctcaaacaggaatttggaatctaagacacagctattttcatctttatgttcagcagtctgtaacattgagaggaatgagtagagtgttaaagcagacggtgaaagttcagtatctgccggtttcattgcataagtgtaatccactggttgtttcacaatatgttcaaccagatggtcaatgcccatactttcggcaatatctaaggccagtgagtaggcctctgagcgatattgacgtgcggggtgaatcaaccaaatatcttcaaccggttggcgaccttcacaagcaaaagtcagtccattcgcttcagctcgttgctctcgctgttcttgaatactcattcccggagtgagtccaaagttatgggcaatttgggatagataatcttcttgattatcttggttatcgagcaatgaagagccaagctgagataaatcagtaatagcgttattctgctcatcatcactttcgttatcatcaattacctcatcaataatatgttgagctttttggggagtaacggctttattttcatttttgatgagaggttcagattttgcagtttgttgttcctgtctggtattgatttgatcgactgttttttcaactaaattatcaatttcttgttgtttagccgctatttttttgaatttttgttcatctaagtcaatatccagataaagtgtttcaaaactcactttaccctctaaagcttcaaccattgccgtaatcaattcactttggaattcttttgcttgaaatggtgtagcctcattaaatttggataaattttctgaccagagcgattcaaaagtaacatcagtatcaaattgatgggctgcccatacctcttcagcattattacgaatagctaatagtttatcgatctgtgtatgaccaagaccactaaaaagaacttctggtatatgtggatataagtaattaacacaacgttccattttaagaatgagagcatgagagataatatatccatcattttctaactcagaagataactctctcgaagaaagagacttacctaattttttctcgtaatactccttcgcctgcaaaatccccaatgctttttcaataaatgacaaatccgcacgggtatcattttcaatcaaatgcccgataagtaaattgagttcagcttcgacactgtcggcagtatcaccttgccaaggtttatattgacaactgatggaccaaaattttggatctttggtctcggtaaagagctccttgagtgcctgaatacgagtattaccaccgtcagcgataatatagaaatcttctcccggacgacgggtgatattcggcttatgatctaaccctcgacgacgaatagactctttgatcatctcaaagttagggttacgggttttccgagggttatgctcatacggacgcaacttatccagtgttactgtaatatattcaacatcgctactgtaatgcgttggtgtggctgtttggtaggatggagccgtatttgaaataggtgaaacatttaatccttttgctatcgctgccagtcttttttcatcttttgtcataatctatcctaatgcgttgtgtttgttctgttttcaaatagggcaaattcacttctgaaattcgtcattacggaagtaagtggtccgtttctttgcttgccgataatgatttcagcagtgcctttaaacggagaatccgcatcataaacttcatctcggtagatgaataaaatgacatcggcatcttgctcaagtgagccggattcccgtaaatcagagttgatcgggcgtttattggcacgttgttccacagaccggttcagctgagagagggcataaaccggacaatccatctcttttgccagtaatttgagtgaacgagagatgttggcaatttctaaattgcgattttcataacgttgcgaggtttgcattaactgaatgtaatcaatgaaaatagctgccggtttgccatatttacgagcattttgtcgaactttagtgcgtaatttttgaggcgtgagactaccttcatcatcaataactaaacgatttttccaatgttctaggatatagcccattgctgaggttagttttgaccattcctcatcatccaaactgtctgcctgtctaatattttgcaatcccactctggcacgcatagctagaaaacgttgtaaaatctgatctgccggcatttccatgctgtgatagaacacaggagccgactcgaattttttaagtgtatggtaagcgatagtttgagaaaatgcggtttttcccatagaagggcgggcaccaatcacgattaaatcgcctggctgtccacctgttgtcgcttcgtcaataccttgaataccagttggagtacctgtcacaggatctccatttttagccgagagttccatacgagagagcatattggcaaaaatatcacttaaatctgctgcagattttgtattatctgataggctaaactcagtaatttttttctcaatgtcatcaacaacagcttcaaacttatctggcgttttcgcactctgtgtctgatcaacaataaactgccccagttttaaaagctgtcgctgtttactatataagagaacgatatccgtataagcgtggatattagctgtagatggagtgtttttgactatttctgcaagataagcaaatccgcccaaatcctcgatcacttttttctgggtaaggtattgatccaatgtcaatatatctgctggtttaccggcttcaatcaattcggaaatatgcttaaacagtagacggtgagtaaaattataaaaatccccctcattgattttgctactcacttcatcaaagagttcattatccaagagtaatccaccgattactgaaaattcagcctctatagaatgcggctgtacaagtgatttatttaagctagacatacattctccctctatgctgagaagtgagagtttgcaaactgtggcatcagtaacgcacaaagctgactgatcgtttcatattcagcttggctctgacgatagaccggttttgaaaaagttgccgcttcacgatatgccacgcggtcaggtaccgaaaattccagcaatgttttgttttcatcaaactcattttggaagagagtatgaaggtagtcggaaaccaatttgacatctttagtgtgatcaacacagttaatcatcgctttcagcggtggtagggtaaagccaaatgccgtaaaggtttcgaggtcttgatacattccaatcgtgccacgaataaactccttagcagataaaatgtggggaagaataggacagaataaaacatctgctgccaatacagacatatcgacagtaatatctctggtaccacgagtgtcaataatgatgacatcataaccttcaattttctggagcagtaaactaaaacgtaatgcaccgtcaggtgaatctctcagcattgggctgattttatttgacgggtcattagactggatcaagtcaagatttgggatagtcgttctagaaataatgtgggtaggatctacatctttaaaatgcagaaattcgtaagttccaccgggagcttgatattccaactcataataagagcttaatgtgggttgggtatcggtatcaataagaagggttcttagaccgtgttctgcacagaatgcaccaatgttagcagcattcgtactcttggcagagccacctttagttgaagcaatagtaatggtaaaaggtttgtttgtaccgttttgtaatggtttcataatttactctcttaacaagggttaaggagtattggccattaatacggtgtatttgaattgattatttgaaagagagaaactacaagtgtgattcaaatggtgcctgaggtcggactcgaaccgacacggttattcaccaacggattttgaatccgtcatgtctaccaatttcatcactcaggctaagagtgctttttattcaatcgcctgtatgtcctatcagtttacgcataagattttgaatccgctacgtctaccaatttcgtcacactggctgtgtgctttattgctcgacattatacgtttataaacttaccttgcaagtggtaatttaatattttggtttatttgttttaattttcaacaaagttacctcaaccgcactttacaaaaatattttatagtaaagtgcggttgtttttttactctctttttctattaagaagccaccaaatgagaatcataaaaagtaaacttggaatgagggctgcaagtacaattggtatatcatacagaaggcttaatcgccctaaaatttcgttgataacataaaatagaaacccaaaaaaaatacctgttacaatccttgctcctgcagtaacactgcgtaaagatccgaaaataaaagaaagtgccaacaacatcatcaccgcaacagagaccggttgaaagactttttgccaaaaagtaagttcaaaacgtttagcatcttgtcccgtttctttcatgaatttaatatagttgtataatccggtcatagacaacgacgttggacgcaaagaagctatccccagcttatcgggtgttaacgttgtactccaattatctttcaagcgattaatcgttttaatttcatcagcaaaaatttgtgattgattaattccgcttaatttccatttaccatgttcaaaacttgcttggttcgcatgtgtaacttgtttcaattgacgcttatcatcaaaactataaatatagatatcattcaagctaatatcattagtaatacgaccaacatagataaaatcattaccatcttttgcccaaatactattttttactgaaagcatggagcctccggaaattgcttttgcacgcatatctctggcaaagtgttccgtctgtggaataccccattcgccaataatcattgtgataagcatcaatggcaatgcggttttcatcacggctaaaccgattctaaagcgagaaaatccagcagattgaatcacaataagttcactacgacttgcaaggttaccaagtgcaataagtgatcctaataatgcagccataggaaaaaatgtttctatatcttttggcatagttaataaagtaaacagtgttgcctgaataacatcgtaagttccttttccaatactacgaaattgttcaacaaatttaataatcgctgataaacccaccaacatcagcaatgtcgccaaaatagtacctaaaatattttttccaatatagcggtctaaggtattcatcatcattattcctgattaccttttacttgaattaaagttaaataaataacgtattttatacataaaaacactattccaactgttcaataaaacagctaaaaataaaaagaaaatactgactaacggcataaaaatatgtgcttcaattttaccggaagcccccgctgattttaatgaactttgtaacaagaaataaattaaatacaataaaagtgcgggcaaaatcttagcaaaccgcccttgtctcggattgactcggctgagcggtactgcaataagtgccataatcggaacagcaaaaattaaggtcaaacgccaatgcaattccgccttagctgcaggtgatttagaattaattaattcctttaggcttaaaatttccgtttcagatgtatccttatctgttgtcttataatctaaataggcttgatactggtcaaaatgcgtgatacgaaagtcaggtaaaagtgcgcttccttcaactcgctgactattttctagactaagaacttgatcgccattgggtaacgccttcaactgaccggtttcagctaccgttacggaaggcttctgattttttttattttccatttggaaaacataaatatcttgaatttgattgttttttatttcattgataaatagcacaacatcagtatttccgacattaacaaattgtcccgacgctaaagcccccattgttggatttgcttttgcatcatcaataagttgaatttgtttttgcattgcccaaggggatagataaaacacattataggttgccaatcctgctgtcaataaagataaaattaacgcaacaccaacaagaatacgctgaccaacaccacaagcccgcatgacggtaatttcgctttctgcatataaacgtccaaatgtcagcaatatagcaataaataagcaaaggggaaatataagttgtgccatcgtcggcatacccaagctaagcaaagcaaaaaccaaatcagccggaattttaccaacagatgcagaacctaatacacgcacaagttgttgactaaaaaaaagcagtaaaagaatagataagattgcaatttggcttctaaaaacttctttggttaaatatcgaattaatatcactgaattacctatatttctcttgcaattttaaaaaaaagcagtaatttacgaaatcacatacatggcgatgtatgataacgtatttttttattgaaaacagtaaattcgtgaggattacatgaaatatagtgcaaaaaataccgcactttctcaaattgacagcaacattattttagccgtatttgaggacggagaactttctccgacagcaatgcaatttgaccaactcagtcaaggctacctaactcgcttaattcaagtaggtgaagttagcggaaaacagggacaagttcttattttacgggatataccgaattgccaagcacaacgtatttttatcgtagggtgcggtaaaaaagataaaataacagaacgtcaatataaacagattattcaaaaaacaattcaaacgattcttgagactcaagcaagtgaagttgtgagctttctaaatgaaattgaactcaaaaatcgtgatattcattggaatattcgttttgcaattgaaaccattgaagcaagtcattatcaatttgatactttcaaaagtaaaaaaactgatgcaagtttagtattggatagatttatttttaatgtgccaaccgaattacaacaaaatgcactacaagcaattagttacgcacaagctattgcattaggagtcaaatatgcaaaagatattgccaattgcccgcctaatgtttgcaacccaacttatcttgccgaacaagcacaatccctcgctaaacactcaaacttgattaacgtgcaagttttgggtgaaaaagaaatggcagaattgaacatgttctcgtatttagctgtttcgcaaggaagtgctaacgaagcaaaaatgtcggtgattgaatatcgtaatcaccccgataaaaatgccaaacctattgttttagttggaaaaggtttaacctttgatgccggcggtatttcattaaaacccgctgatagcatggacgagatgaaatatgatatgtgcggtgcggcttctgtatttggtgttatgtacgctcttgcaacattacaattacccttaaatgtaattggtgtattggctggttgtgaaaatttgccggacggaaattcatatcgaccgggagatattttaaccactatgtcaggattaaccgtcgaagttttaaatactgatgcggaaggacgtttagttttatgtgacgcactcacttatgttgagcgatttaaccctgagttggtcattgatgtagcaacactaacaggtgcttgtgtagtggcattaggtcaacataacagtggcttaatcgcaacagatggaaaacttgctgaaaaattattaaatgcggcagaagaaacgaccgataaagcttggcgtttacctttaagcgaagagtatcaggaacagttaaaatctaattttgctgatttagctaatattggtggacgttggggtggagccattaccgccggtgcatttttagctaactttacgaaaaattatccttgggctcatttagatattgcaggaactgcctggttacaaggtacaaacaaaggtgcaacgggacgaccggtaagtttactaacgcaattcttaattaatcaatctaaataactgcaaaagtgagagtttctcttttagaatatgagtatcaaaattcaatctaaacaaaaggagactctcattttttattccactgatccatttggctgagatttccaccgcacttaccttctatctatcgccatcattacttaactaatacaactaatccagaattttattaaactttgatctataaaatttcagtataaaagatgattttatgaatgaaatgagctaaagtagccgagttttttagcaaggatgatttttaaggatacctcatgaaacaatctctgcgtcataaaaagataattgaattaataaaacagaaaggctatttgagtacggaggaattggttaacattcttaacgttagccctcaaactattaggagagatttaaatgaactggcggaaaataatctgattacacgtcatcacggtggagctacttcactttcaacatcagagaacagtgattatagtgaacgtcaacatttcttctcgtctgaaaaacggcgtattggtcaagaggtggcaaaaattattcctaacggttcatctttattcattgatattggtacaacaccggaagctgttgctaaagcattattggatcatcaaaacttaagaattgttacaaataatcttaacgcagcctatattttgatgcaaaacaaaacatttgatattacgatggctagcggatctttgcgtcaagatggaggtattattggtgaagcgacaattgcatttatcggacaattccgtttggatttcggaatattaggtatcagcagtattgatttggacggttctttattggattacgattatcatgaagtgcaagtgaaacgtgcaattatggaaggctcaagaaatactattttagtaacagatcattccaaatttactcgccgagcaatggtatatttaggttcgttaacagaagtagactatttgtttacagacaccacaccacctgactccatgcttagccttattcattcaagcaatgtaaaactgcatatttgtcaatagaatttttatcaatagagatgtgtagaagattttatcttctacacaataatcaatttaatgccctcgccaataaactgacagggtgtaaacaagaagcacttgttgacatatcaatttgccatttgcaagtttcacattcagtgatgacataatcgaaacaaccttgttcaataacctcaaataaactttttccgatggcctgtgaagtctgatagttttcagatttaaagccatatgttccagcaataccgcaacattgagacggtaaaatagtaacatcaagatccggtatttgtttaagcaatgccaacgtataaggtgcccaccccgctttttctacatggcaggcggtatgataggcaactttaagaggtgtagacttaaagtgcggtatttttccatcaagatatagtcggtaaagatatttggttgcaatattgacatgaggacgaattctcgcattatccatccccaaaatatgatgatattcatcacgtaagttcattgtacaacttgaagatgtaccaataatatccaatgctttttcttgaatcacccgttcaatttgtttaatgttaaactctgcttgttttttagccttttcaggaaaaccgttcaccatgagcggcaaaccgcaacatttttctttttcaagcaaaatcacgccaatatcaatcgaattaagtactttaatgagatctttaccaagttgaggataattataatttacataacaaccgtgataatacactatcttatcccgaaaatagatctgacggtcaagagcatattttttataccattgacggaacgaaccgaatgaatattttggtaaagtgcggtgcttactgaccttaagggttttatctaaaacatatcgggttgcttttaatccagtaatcgcatttacaatcggagcaaaaggtgtattcattttacccatgatatccgtattacttaatacagcatcacgtaatttatgtattggtgatttatgttgttggtcaagatatttatttctagcacgaatgataatatcaccaattttaacgtctgacggacaagcaacctcacaacgtttacaattgatacaatattttaatgcttcatcataaagtgccgcactttttaagcgtaaccgttcaccgtccggtcccgcctgtttaggtccgggatagaaaggattttgacgagaaacagggcaaaccacagtacaagcagtacattttatacagctctcaaaactttcatcggtatggtgctgagtaataggaaaagcagcatgctgttttgcattttcaatgagttgttgaatattcatattttgccccttatactcgattttgtgcttcgataatgttatcggcagctgttagtgcagtaacaactgccactccggaaccacaccctagttccaatgcattgtatccgccaataacatttccagcagcatataaatttttaataatctgaccgctcttttttaattggcaacggctgttaattgcaacgcccgcagactgataaggctgaggtgaagaaaaacgccgagcagtccaagtgagtctgttttgtatatcaatcattgaattgccaatcatgtccacgtcaaatataggttcaagtaaacgatcaaaaacactcaccaaaccattactgaaaaaactgccggaagcaagaacaaaatgttctgcaaaaataccatgttcttgatgtaattgagtgtaaatttgtttaacctgttgatcctcaataacggcacgcaatgctttatcaccatttaaaataaaaccgcccagtttttcaaaatacgtttttaattttttatgttgacgcaatcccactaatgaaggcggtaatgtaggcaattcgtataaatttaatccagtttccaacgttaatttattgaaaaaatcttgattatccaaaccaaaacaagccggtaaaaaaattgcttccccatctccggaggcttgttttatttcctgtaccaattctcgaaacgccaaacgatgttcaagtaattgggaaatattgacactgcgaaactcacgagaagttaaacgcaattgatccaactcgggaagatgtaaaagtgcggtcgttatcgaacaatgtgtaaattgcggatgctgtattaaattttcagccagtaagtgcggttgaaaatcatgataaccttcaatgcccaacacagtaattttttggtatccgaaatgttcatcatgaagatccattgttggaatacaatcagcggacagccaagtgcggtgcaatccgcccaacggcgtaacacgaaaatgattttgcttatagcttcccgtcacattgagattaattttttctattaattgttcaaattgcttggctttttgtaaaacatgttgtttaccaaacaaacaatacggatgatttggaagttgttcttcaaggctgtcataaccttgttcaaaagaatttatcttttcaccgtttggtaattggcttaaaagatccattgaacctgatgaaaaattcatggctgattgaccattattaataatcgcacaacatttccctttttgttgaagcataattccgcaagttaaccccgcaagcccgcctccgataatcactacatcaaatttcattgccatctgttccttgctgtgcttgttcagttaaagattgaacactatttaagcctaataaactgtaatatatccaactggaaaattccgcttcacggattgcttcgccccaagcaatcggttcaatacctcgccaacgttcttccataaaagatgataattgcagtgtagattgtctaggtgttgccatatgaaaacgtgccattaatcctgccgcacggcaagcacaaagttcagcctggcaagttcccatgcccacacgtgtacgacgacgtaaatcaacaagattattgactttcaattcttctacagcataacgtacttcaccggcagtcaccgcttcacattcacaaacaagtgtacaatctgaccgctcttttccaatcaaacgagaagcccgttgcccatgacgataacgtgcggaaatttgaagaggtgttggtaacgatatgattttattaatatgaggaacgttttgatcagattcagaacctggaagtaattcttgggcagttgtacaaacagtttgtttgccgagttttttactaactaaatcagttgcccattccgccatcaaacgataagtcattaacttacctcccgtaatagtgacaaaaccttcaagaccatcacggcttgcatggtcaagcaatacaataccacgactaacattacgtcctgatggatcatcatcactcgctaccagaggacgaacacctgcataggcacgaagtactctagtatgacgtaaactcggtgcaagtttttcgccttctctaaataaaatatccacctcttcgggagtaacaatcatgttatcaatttgatcataagggatacgatctgatgtggtgccgataacacagatagtatcgccgggaactaaaatatccgcatcagctggtttgcgacatcgattaattaccaaattattaatgcggtgccccatgacaagtaatgcacctttagcaggaaacatcttgactttgagatcggcatattcagcaatcccctgtccccaaattcctcccgcattaacaataacctgagcaaaaaaacggcgatttattttatttttgtgatcatatacttctgtaccaatcactcttccgccttcacgaatcagttgagtaactgcacaataggtaaaaattttagctccatgctcacgtgcatccaacatattggcagaggttaaacgaaacggatcaattgaaccatcgggaacaacaaccgcacctataagctccgggtttactgaaggctccattattctggcaaggtcaggctcaatcggtactgcttcaatacctgcttttgtacaggattgaataaatatcttttgataattaagatcgtcttcaggtaacgtaatgaaaagccctttggtatcttcaacacaatgacgtgcaatacgttttaagatcttattttctaagatacattcctctgccgattcatgatcattaacagcgtatcttgcaccgctatgcaataaaccatgattacgtcctgttgcacctgtggcaatgtcataacgctctaataatatgcagtcaatcccacgtagtgcacagtctcgtgcaataccggctcctgttgccccaccgccgataataatgacatcagcactgagcggtggaaaatctttagaaaatttttgagacgacattgacataatcatcccccacattgaatgtaaaaaattactattagaaagtgattatataatacgtcaaatgttcgttttagaaaataaaatgagtgatttcttatcaaataatgtgattaagatcactttattagtttcgatttgaattttttttgtgtttttttgtgatttacatcacaacataaattaaattagctttttagatttcactttttggttattatatgagtgaacgttcaaaaaagtgcatttatcgctcctaattttttatacataagattggtttgataattgctatattttaatctaactaaactactggagatttattatgtttggtccatttaagcccgcaccgtatattgaggagctatcaaaagatagaatcgatccaacttatagacggttgcgttggcaagtattcatgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgtttctatttggaactgtgcacataatatcggaggtatggtaccgggattaatggtattgttggcaagtgcgatttatttcagcgagtttggagtacaggcaactgcaaaagatatttggcaacaagcgttatattatccgggtattgccgctatgatttgtgcaattccggtctattttgtgatgaaagatacaccacagtcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgaattagctgcggtaccgggtacattattatgtggttgggtttccgacaaagtatttaagggtaaacgtggtttaaccggtttcattttcatgattttgactactattgcagtggtagcattatggatgaacccagcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataaccggtggtattttagccatcctgttaatgtttatcaccatgatagaagaaggtaaacataaagcaaaactagacgatcattacggtaaataatcgttaaaaaggaaagacaggaaactgtccttcctttttctttattaggtttatgtattcaaattttaaccacatttttatcacagattttacttctacttaaggaaaatacaatgaaattagctacccctctttgtgcaattgctttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatgggcgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggctacatcaccaagaaggcaaagatattgctttagcaacattaaaagttttgaaaaaatacggttatacgcaaaaagatgacttagtctatttacaaacttttgattttaatgagctaaaacgaattaaaacagaattgttgcctaaactaggtatggatgtaaaacttgttcaattagtggcttattctgattggggtgaaacacaagaaaaaaatgctcaaggcaagtgggttaattacgattatgattggatgtttaaaccgggtgcggtagaaaaaattgcaaaatatgctgatggtataggccctggctggtacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataattcgacattaatatctgtcattcttttaaacgaatgacagatttttgttcttgttgtaaatagccatttctccattatcctagcctttcaacctcaaccttcccctacgatatttcgtgcgtaaaagtgcggttattttatccggtgtttttattgcaatagaattagcaatctgtaatgagttatgaatagaatttgcatgggtaatggcaattgccaacgcatctgctgcatcaacctgcggtttatcggaaagttgtaataaccgaaccaccatttcctgtacttgtgatttttcagccgcacctgttccaacgaccgtttgtttaattgttctagcggaatattcaaatacgggtaaattttgattgactgcggcaactattgcagttcctcttgcttgccccaattttagagcagaatcaggatttttcgccataaaaacctgttcaatagcaaattcattgggattgaattgcgtaataatttctgttattccggcataaattcgttttaatctagttggcaaatcatctattgaggtacgaataacaccacttcccaaatattctagcttatgcccaacttgacgaacaacaccatatccggttactcgagatcccggatctattcctaaaataatagacatcctattttccaaaaaataaatgaacctcatttgagatccatttaatatagactaaaaattattttccaagtttaagagattgagctgatgaaacgtttttcatcatgcctctcaactaatttcataaatgttcctgatagaaaaaatgaagctaacttttaaagtaaagcggcaacctcatcacttatctcgccattatgataaacgttttgtacatcatcacaatcttccagcatatcgatcagtcttaacaatttaggtgcggtttctgcatccaaatcaaccattgtggaaggtatcattgttacttcagcattcacaactttaaatccggctacttcaataccgtctttcactaagcctaaatcttcccatgctgtataaatttcaacactaccgtcttcttgtacttgaatatcatcagcacccgcttcaatggctgcctctgtcaaggcatcctcgtcagcagactcaactaaaattagcccttttttactaaataaataccctactgagccttctgttcccaaattaccaccgcactttgtaaaacttggtcgtacttgagaaatggtgcggttagcattatcgctgagacactcaaccatcaccgcagtcccgcccggaccatagccctcataaattctagtttccatattggtgccatcaccaccgcctacaccacgctcaatagcacggttgatagtatctcgtgtcatattgttagataaagctttatctactgcggcacgtaaacgagggttagcaccaacatctccgccacctaattttgccgctgttactaattcacgaattaatttagtaaaaattttaccacgttgtgcatcttgtgctgctttacgatgtttaatattggcccacttactatgtcctgccattttatattccttttatgattgtacttttatattcattaatcgcctctgcattgttgggcgatttagtcaatttaattgcgtcctgtaccgaacaccattgataagctgaatgttcacttaaatttattactctttcatcagctaacggcaacaaaaaccaatgctcaatgcagtgagttatatcaggcgcatatttatacctaaaatgcggaaaaatttcaaactctatctgtttatggcaattaaagagcggtaagttttccgcaagaatatctatgccggtttcttccctcacttctcggattgccgtttgaacaggtgtttcacctatttccatcgtaccggttacggattgccaaaattccgaatcgtcttgacgttgcaacattaaaacacggttggttttcttggcataaataacgaccaaaatactgttgggatttttatagttcatttggattaccttcttaaagtcatcatcactcacattaaccaaaataatgttaaatgaaaaaacaacaattgatctgccccaaaatctcttaataaatcaaaatattaaaacatcattaataattaagatagcatttcaaatttcgtatcattgctacatagtaccgacttttttagcaaatttttctacctttttcttttcttctaattctttttgttgttgctctgcacgtttacgacgaatttctttcggatccgccaataatgggcgataaatttcaatacgatcaccttcattcactatatccgttaattttgccgggcgactgaaaatgccgactttattttcacgtaaatcaatttccgtaaattcctgcaaaataccagattggaaaatggccgcttgaatgattgtccccttctcaacttgaagttttttcaaataatatttatgcggtaacgcataagtaatttctatattaatcaagataaacgtcctttgctcgttgtttaaacgcttcgatcattttcgttgtcaattgtgaaaaaatccgcccgaaagcaaaagcaataacagggttggaaaattcaaactccaattgcaacgcaatttcacaactttgctcatcaatttcacgaaaaacccatttaccctgcagatatttgaaaggtccggaagctaactgcatcgtaatctcttggttgggaattaattgatttttagtcgcaaaaacctgtttgataccggctgtgctaatggttaattctccgatcgtttcattgtctatcgactgcaatgctcttgccgcaatgcaatggggtaaaaattgtggataactttcgtaatcattaacaatatcgtacatttgtttagcactataagacactaaagctcgctgatttatacttggcataaaataagatgttgaacaaaaaatgttgcaattatagcggaaaagtgcggtagaaataagagacaaaatagaaaagaatgattcatacaacaagctgttaatgtcgttgctttctaattgagcatacatcaattttccgctacaatagcccactatttttagcgaacaaaaataccaatgtcagaaattaaattaattgtaggtttaggcaatccgggcgataaatacgccgatactcgtcataatgcaggagaatggttaattgaacgtttggcaagacgctttaacttcaatctctctgttgaatccaaattttcaggaaaaacggcaagagcggtcattagtggtcaagaaatgcgttttcttgttcctaccacttttatgaatttaagtggcaaagcagtaagtgctttagctaatttttatcgtattccgccggaacaaattttagtgcttcatgatgaattagatttacctccaggcatcgctaaacttaagcaaggcggtggacatggcgggcataacggtttgaaagatattattgctcaactggcaaataataaaaatttctatcgattgcgtataggaattggtcatccgggcgataaaaatttagttgcatcttatgtgcttaataaaccgtctccaacagattggcaattaattgaccgcactttagatgaggcaacggattgtattgaaatcctcatgaaagagggaataactaaagcaacaaatagactgaatgcttttaaagcataaacaaaattcaccaatctttgggctgaaataactcttctactctactaataaaaaataggaaaatttatgggatttaaatgtggtattgtcggtttacctaatgtaggaaaatccactcttttcaatgcgttaactaaagcaggtatcgaagcggcaaactatccgttttgtactattgaaccgaatacgggcgttgtaccgatgcccgatcctcgtcttgatgcactggcagacattgttaagcctgagcgtatactaccgaccacaatggaatttgtggacattgcgggattagttgccggtgccagtaaaggtgaaggtttagggaataaattcttggcaaatattcgggaaacggatgctattggtcatgttgtgcgttgttttgagaacgatgatattgttcatgttgccggtaaaattgatccgttagatgatattgaaacaattaatactgaattagctttagcagacttagatagctgtgaacgagctattcaacgcttgcaaaagcgtgcaaaaggtggcgataaagaggcaaaatttgagttgtcggtcatggaaaaaattctacctgtactggaaaatgcaggtatgattcgttctttggatttagataaagacgaattacatgccattaaaagctacaacttcttaactttaaagccaactatgtatattgctaatgtgaatgaagatggctttgaaaataatccatatctcgacaaagtgcgtgagtttgctacaaaagaaggttctgttgtggtaccagtttgtgctgcaattgaagcggaaattgctgaattggatgatgatgaaaaaactgattttttacaagatctcggtattgaagaacccggtttaaatcgtgttattcgtgcaggctatgcgttattaaatttacaaacctacttcaccgccggtgtaaaagaagtgcgagcttggacagtttccgtcggtgcaacggcacccaaagcggcagccgttattcatacagattttgaaaaaggctttattcgagcagaagtcatcgcttatgatgattttattcaatataagggcgaggcaggtgcaaaagaagccggtaaatggcgtttggaaggtaaagattatattgtgcaagatggcgacgtaatgcacttccgttttaatgtttaatattcacaactaattttataccgcatttttcgatttgaataataaaagtgcggtattttttatagagaaagatgaaatatcactttatttccctgtgttccattaaagtttttaactgggagacgtttgttgatgttgaagatttagcagatgatcctgcgagaagacaataaccgaatgaatgatctttagtgtggcttgtgtcataataggcatcgttttttcagcgacttagaggagaatgattacatgagaattttacatactatgttacgtgtgggcgatatggatcgctcgatccacttttatcaacaggtattaggcatgcgtttattgcgtacaagcgaaaacactgaatataaatattctttagcttttttaggctatgatgatgaagaaaactcatctgttattgagctaacttataactggggtgtaagtaaatatgaaatggggactgcttatggtcacattgctattggagttgaagatatttatgccacttgtaaagcggttaaagaagcaggtgggaaaattactcgtgagcctggtccagtaaaaggcggaaaaactgtcatcgcatttgtggaagatcctgatggctataaaattgagtttattgaaaataaaatggcacaagcagggctaggtaatcaataacctcaacaatttttatcctaaaaaatgggctttttatctgcctattttaagtattacatttatctcattcttataaggtaatatttcgtgaccgcactttcagaacaagcagtggattataatttacttaaaaatcgctttcggggtttttttcctgtcattattgatgtggagacagcaggctttaatgctcaaacagatgccttgctggagctagctgcactcacactgaaaatggatgaaaacggtctattagtaccggatgaaaaatgccattttcatattcaaccgttcgaaggggctaatattaatcctgaatcactcaaatttaatggtattgatatagacaatccgttgcgtggtgctatatcagaaaatgttgctatgagtgaattgtttaaaatggtgcgtcatgggcaaaaaaaggctgactgtcaacgttcagttatcgtagctcataatgcgacatttgatcaaagttttgttatggcagcagcagaacgtacgaaaataaaacgcaatccgtttcatcctttttcgatatttgataccgcaacgttaagcggttttatgttcggacaaacagtgttggtcaaaggttgtcaggttgccaatatttcttttgatggaaaaaaagcacattctgctttatatgatgcggaacgaacagctgaacttttttgttatatggtaaatcatttaaaaaaactgggcggttttccccatgtggcaataaactcataaaaaacggtgctaacaaagcaccgctcttttgcgttactccttattcaaattactgtacaacaatactccctaagcaaccttgatcagctaacactaaatcagatgaaccgaaaataaaagggaatttagtagaggacgcatgattaaattgcactaaaatttctaccttgccgtcaatccaaagactatctttccatgcaatatccgattgttctaccggctgatcatttatgcttttcatgacaaaacgagcaccttgaattttaaatccgacgggccttgaagaacttagaatccagcgttctatctgccctcttttggtactaatgtctattctattcggttcaaaccgttgttgattaatggttgcattgctcacatcaaaataaaactctctcgttttcatatttttctttgccaataaactaggtgcatcagtatgaaattgccaatgacttggattataaaatactgatttaaccccctctgttcttaactcaacaataacattatcaaccagcatatcagaactgaatattgtacctatcttattcaaaagatttcttttactaccagtaattaaggtaacatttccgccctcacttaagtcaaccaataattcaaccctttcactaggtgcaagagaaacttttttgacaatttttgtttgtggcaaataaccttgttctctggcaatcaagaaaaatgcccgctcatcatcaaatgttaaatcataagaacgagataaagaggcattcaacaaacgtaaacgtaccaatcctttaggtacattcaaataaggtgcttcaacaccattgaccaataaccgctcgcctagaaagtgcggttgattttgaaatacttgctctcccttagaatttaacagtacatcttgcaaaataagtggaatatcatcaacgccatatttttttggcagtttagattgatgagtatctttgtcatttataatccacatgccaactaagccacgatacgtttgatacgctgaattagctaaagtgcaggcatgataaaaacaagttgatgccggttgagtaataggtaaaattggagcccatccttcccctgccttcaatactcgcccaataccaccaattaattcactgtgtgcttgtaaaccttgtatattcatagcaactgcctgcgttaaattattacgataatttaacttcacaaaatcaccttgctcaactcttacggtaggacctaaatgatgcccattaaatccccaaacttccgttagctttttttctatgaatgaagtttgagcagcttgcatcgttaaaaatatcggtcgcccacgttttgcctccaataacggtggaataaataaaggcaaacggctagcagccattactgattgagggatacatgataaagaactggctaaaataccgcttttcaaaaaatcccgtcgagtcaaagatctcatattttaccttgctgcttatacagattgctgttgaatttctgcatcaagctctgcgatgcgttgttgcataatttgatgacaatattcagctaattcccgtacattatcctttgtgtagttcgatgtatctacaggagacatcatttcacaaatcactttaccattgtcccaccgatttaggtcaatgcgattatgggtggttgaacaaacgactggaacaattggcacaccagcggtaattgccgcataaaaagcccccattttaaaaggtaataatccacgcccacgactacgtgtcccctcaggaaacatccaaactgacaaattatcttcatttatacgatgagcaagttggtttattgtattatgggctttggagcgattttctctgtctaacaaaatatttcccgttgcccaataaagaagaccaaaaaagggaatccaaaccaaacttttcttgcctacactgactgtacgagggcgaaccatagcagaaacagtcaccatatcataattattttggtgattaccaatatagatgcacctaccgatactatcgacattttcaggaaaacgatgttcaacttttaatccaaaaaaaggatataaacgcccaaaccagcgagccatcacacctacattacttggatttttaaaacgaataagtgaataaagagatcctactacacaaattaaaatactacagaagataacaacgatggctcttaataatatcaacataaatatacccctaaaaatttgtatacgccaagtataacgaaaatctaaaaataagtgtagaaaagcataaaaaagtgctaggctagcacaaatattttaggaacctcagcatgaaaaaaacattctttattgcagatttacatttaagcgaaaaccgaccgcatttaactgaactctttgttcattttatgcaaacgcaagcaccacaagcagaaaaactttatattttaggcgacttatttgatttttggattggtgatgatgaacaatcagcattgatcgaaacagtacaacaacaaatattacaacttactcaaaaaggtatctcttgttattttattcatggaaaccgtgattttttggtgggaagacagtttgccaacagttgcggaatggaattattaccaacctatcagatcgttaatttatatggtaaaaaagtacttatttgccatggtgatacactctgtaccgacgatcttgcttaccaacaatatcgcaaaaaagtacaacaaaaatggctgcaatggctatttcttcacttacctttaaaagtgcggttaaaaattgcagaaaaaattcgccaaaaaagcaaaacggataaaacacataaaagtattgaaataatggacgtcaacaaggattttgtagaacagattatgcaacagtttcaggtcaacattttgattcatggacatacgcacaagcagaatattcatcaaaatccaccgcactttactcgcatagttttaggtgattggggagcaacagcttctgttttagaggtttcagccaatgggtttcagtttatctaattcgtcaggcacaaaacctaaacataaagaaaaagagatcaaaatgtgctatttttccatcacaactaaattttttccaatttggctaaatgcgcgattagccatttaataccttgtccctgaaaagcgatttgtaatcgggtattattatcagccccctcaacattaatcactgttccctgaccaaatttttcatgtttcaccttttgtccaactttccaactattatccgataaatcagttttgacgatagaacccactgcacttcggttataagctcgagtcactgtgccacgtaaacgaacttcttgaatacattcttgcggtaattcagcaataaaacgagaaggaatatgtttttcgtctttaccatacaagcggcgaacttccgcataacacaatgtcaatttctgttttgctcgagtaatccctacataagctaaacggcgttcctcctccaaacgtgccaagtcttcacccgaacgaaaacttgggaaaagcccctcttccataccaacaataaatactcttggaaattctaagcctttcgctgaatgcaatgtcatcatttgcacacaaggctggtgagaggctgcttgttcttctcctgcttccaaagaggtatgtgttaaaaacgccactaaatcagacatatcttcagcctcatccggttttataaattctctcgttgcggtaaccaactcctccaaattttcaattcgcacttcccctttgtcccccttttcctgtttatacatgtcatataaaccggaatgtttaatcacaaaatcagtttgtacaaataggggcatttctgcggtttcttgttgtaaggaattgattaattcaataaaacgtaacaaaacagttaccgaacggataggaattaaattttcttgaatagcaagctgagttgcttgccataaagtcacttgtctttcacgagttaaattacgcaaaatatctaaagtacgctcaccaatacctcgtggtggcgtatttacaacacgttcaaaagccgcatcatcttgtcgattggcaattaaacgcaaatacgctaaagcatctttaatctcttgtcgttcaaaaaatcgcataccgccataaatgcgataaggaattttagccctgagaaatgcctcttctatcacacgagattggctattgctacgatataaaactgcacaatcatcaaccttaccgccgttatccagccaattttgtacctgaccggagacaaacaaagcctcatccaactcgttaaaagccgcataaatccccacaggatctcctttttcacccgcagtccaaagatccttacctaaccgattactattattggaaattaaacggtttgcactttctaaaatgttgccggttgaacgataattttgttctaaacgaataattttcacttttgcaaaatctttaagaaagcgatgaatattctcaatttgagcaccacgccaaccatagatagattggtcatcatctccgacaatcattacattgccctgcgaaccggctaataatttaatccaagcatattgaattttattagtatcctgaaattcatcgatcaaaacgtgctgaaaacgctgttgataatattgcaaaatatgtggattttttagccacaattcataagctctcaataataattcagcaaaatctactagacctgatcgatcacaagcatcttgataaattttatagatcttgatccactctcgctcttgacgatcattattatcttcaatctgatgagggcgtaatccttcttcttttttattattgatataccaacaagcttgtttatagggaaaggctttttcatcatattgatgcaatttcatcaaacgcttaactaagcgaagttgatcttcactgtctaaaatttgaaaatcctgtggcaatccggcatctgcgtaatgggatcgcaataagcgattggcaatactgtgaaaagtgccaatccacataccgaataaacgttgatgggaataacgagctaacgttgcctcaatacgatgacgcatttccgtcgctgctttattggtaaaagttaccgccataatacttgattcaggtattttttctaccgcacttaaccaagcaatacgatacgttaatactcgagtttttccgcttccagcaccagcaagtacgagataattccccaaaggtgcaacaacagcattgcgttgtttttcattaagatcattaagtaattctgaaatatccattgtcgcccataaactgtgtttttatacagttgattatattgttttaaccggaaaaagcaagataagaatcaccgaataaatgctgaagcatatttcgccaactttccttcccaaatttccaatccatttaaatatcaaacaaatttcctacataagtcgaatataaacggttatttcttctctatcatgataaagatgttttgcttgtatttggaaagatatatgttgttcatttagtctttctttaatttgttgtaaacaccgcttaacctcaaaataacgctttttcataggtaattttaagttaaaaatagtttccttacaccaacctttgacgagccattgactgattaaatcagcaattctacgtggctgttcaaccatatcgcaaaccagccagtcaattttacaatgcttaggaggccgaaatttaaagccatcttcagcacaatgttcaattctgccggtctcatgtagacttgttgccattttgccatgatccactgcatacacaaaaacacctcgtctaaccaattgataagtccaccctcccggacaagcccctaaatcaacagcatatttattttcgttaaaacgtgttgcttcttgattggggggaataaaataaagaattgcttcttctaattttaatgttgaacgactaggcgcttctgccggaaattttagtcgtggaatccccataatatgttcagcatggttattgttataggaatagccaatgtaacaactgttggattgagtgaaaaaaatatgcagagtaataccgctctttttgttttttgcttgtagccagccttgctttctgaaagcttgtctaagcggtacagtaaattttcgacaaaaagcggcccgtgttttagcttcattggtatcggcggtttctacccaaatatcactactctgtttgagattgaggattttttcttgttgacgataatattcaataatcggactgatacgatcttgcacggaaagattactaataagatcagatacgacaatcagttggcgagcaaaaatcagttgactaaatgtaatctttctagcgaggagatccgcctcaccgatttggtaacattcaaaaataacataacctgaattttctactactctggcaaagccaaaaacaccaagtgcggtggctttttcggttatttccgccgccaattctttttcaaagccactgcggcaatataacgctaatttattcatgtttattttgcttcattgcatgcataatccattgacggaatgcgttaatttgttctgtattggttcgattaagagaatttaccacataaaaagattttggatccggtagagagatagataacacaacttgtaagtttccgttctctatttcgtgttgagcaagaattttatttgccaacacaataccttgtccatgcacagcggcttgtaatgccataaatgtatgactaaataccggtccatgtcgaatatctaatttatccagttgaagtaaattcgccatattacgccagttatctctagtatgaacatgaataagattatgctgatacaaatctgttgcttgcgtaacaggttgtttagcgagtaatttaggggaagccaaaatcaacaattttgcctctgccaatttttcaacttgtaatccttcccaatttcctttgccataataaatggcaatatcaatttcattactcaaaggtatttcgtcttgatcaaccccttttaatctcacctcaatatccggatatcgttgattaaattcacttaattttggtacaagccattgcataccaaaagtttgcggaacgctaattgaaagatattgctcatttttctgagccattaattttgttgtagcatcggctaaattatttagaattttgctgacatcggaaaaataagcccgacccaaatcggttaattctaatgttctatttttacgcttaaataatataacacctaaaaaatcttctaataattttatttgatggctaactgcagcctgtgtaacaaaaagttcatctgcggctttagtaaaacttaaatgccttgctgaactttcaaaagatttcaatgaatttaaaggaggcaaacgtttaatcatcattcttcccaattgtattgtttaaattataacggttgaaattgctatcagattagtttttctaataccatatataaaaaaatatatcttgtctgacctatccattctccatagaatgcacgcatacttaacgattggtaattccttactggttaaagagtttcggacttaagtatgatgttgtgtttgcatattgttcgggaaaccgaaccgagtaacaaattttaagttactcatttacttcctgtatgtatatttaaaccgttttttaggttatgtaccgctctttatgagcggtatttttttatgggcaaaattctatcataaaatttcccatctctatcattccgagcgataaaaatccctttatattttaaatatccagtttccaacctgatgagaatagtgtagattaaattcactattttataaacatcaagaaggaagtaaaaatgaataaaaatattgattgggaaaatctcggttttagttatatcaaaacagattatcgttacattgcttattggaaaaatggagcatggtcaaaaggtgaattgatacaagataatgttttgcatatcagtgaaggttcaaccgcactccattacggtcaacaatgttttgagggcttaaaagcctatcgttgcaaagacggctcaattaacttatttcgccctgaacaaaatgcactacgcatgcaaaaaagttgccaacgcttgttgatgcccgaaattccggtggaaatgtttgtcgatgcctgtaaacaagtcgtcaaagcaaatgcagattggctaggtccttacggttccggtgcaacactttacttacgcccatttttaatcggtgttggtgataatatcggggtcagtccggctcctgaatatatattctcaatcttttgttgtcctgttggtgcatactttaaaggcggtatgaaaccgactaactttatcgtttctgactatgatcgtgccgcaccacaaggcactggagcagcaaaagtggggggaaattatgccgccagtctttatccggggaaaatggcgaaaacacgtcattttgcagattgtatttatcttgatccgactacacacaaaaaaatagaagaagttggttctgcaaacttcttcggtataactaaagacaataaatttattactccattatcgccgtcaattttgccaagcattactaaatattctctactctatctggcaaaagagcggttaggaatggaagtgattgagggcgatgtttatattgatcaattagatcaatttaaagaagccggtgcatgtggaacagcggcagtcatcacgcctatcggcggtattcaatacggcgatcatttccatgtattttattctgaaactgacgtaggtgaaataacaacaaagctttataatgagctggtcggtattcagtttggtgatgttgacgcaccaaaaggctggattgttaaagtagaataataaaaaatacacaactaatctgcaatttaatcaagtaactttccgatgaaattgcagattttttctgacataaaaatatcttaacgttgttccaatgaatttaaataatccaagacaatttgatgatgatccgtagttttaaatttatcaaaaacttgttcaatttttccctgttcatcaattaaaaaactaatgcgatgaataccatcaaagattcttcccataaactttttttctccccaaacaccgaattgttctgccacaatatgttgctcatctgaaagaagatcaaaattcaatgctttcttttctataaaattggctaattttttcggcgaatccggactgatacctaaaataacaacacctttattttctagctctgctttgctatcacgcaacccacaggcttgctttgtacaaccaggcgtcaacgctttcggataaaaataaaccaatacttttttaccgtgaaaatcttcaagactaatcggtttactatcttgatttaatagactgaagtgcggtgcaaaatcgccggcttttaatgttttcataaaatattaccttttaaaaaatataaaaaaatacttgcaaagtgttgccattttaacgatcctaaacggactttttcaagctaatatgcaaacataataaggagattttatgaccacacacagacctttattctacggtagtatcaccgcacttattacgccaatggataatcatggggaagttgattttaacgcattaaaaaaactggttgaataccatattgcttcaggaactcacgctatcgtttctgtcggtacaaccggagaatccgccacattaagcatcgctgaaaatgtgaaaacaattttaaaaactcttgagtttgccgatggaagaatacctgttattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaaccgttggtcgtttagctcaaattagtaatattattggaattaaggaagcgacaggtgatgtcagccgtgtagcgaaaattaaacaggcggcgggggacgatttcatttttctcagcggtgatgatgcaacagggcttgaaagtatgaaacttggcggtcaaggagtcatttccgtcacaaataatattgccgccgctgatatggcaaaaatgtgtgaattggcattagccggaaaatttgatgaagcagaaatcattaatgataaattaagtgctttacataaagatttattcatcgaatcaaatcctattccggtgaaatgggcggcttataaattaggattaattcctgaaccgatattacgtcttccactgacaactttaagcgaacaatcgcaaccaaaagttattgaagcattaaaaaatgccggattgctatagtcttcttactaaacattagggtctgcaaacgaccctattttttaaccgatttctaggttaagtgcggttgttttgaagggcaaaataatttttatttttttctgaaggtttgtattgtataattcgtcacctaatgtcatgcgtacaatctacgcttatctttttacaaaataaggactttttatgaaatacaaactgtcgttagcgttattatttacgcttccagcctttgcccatgcggggggggtaatttcaacttttacggcaaggcggggattgatttaacctctcgttttgagactatgagaatagtattaaattacaataaagatgtaacaaatcttcctacaagctcaagacaaaacaccttctcaccaagtctctttcttgaagctacctacaatattttaccgcaaacggaaatcggtctcggactaggctatattaaacgaaaagggttcgatcatcatgcgacttggcagatcacacctgaaggtaattacggaataggtggagatgttaatgtaattgaaaaatatagaataaatcgctattcttccctaccaatttatttcacactgaaacaaaattatgcctttaatgcaaatagcaaattttatctaaaaggcgatatcggttattcaatcaacaaaattgataatacaaaatatatttactatacagatctagatcataaaactacaacgactaatcgcaatatgaaagcccgaaacggtctatatttgggtttaagcatcggtgttgaatataagtctttcttagcagatattggatattatcatgctcatgcaaaagtcaattatgaaagtaacggctactattcatggcatccttacaacaacgacgccatacgtttaacgcttggatttaaattctaaacaatactaaacagaataaatcttcaagccaaacttttaccataaaaatccctattgaaatattattcaatagggattttaacatgttcaatcggttaaatctttatgaaaccgctacatcataccaaaataaagtgccattaccaccgcactttcccgctttccgtcaggtaaaggataataatttttacgaatatccacctcattaaaacccaaattgtgatatagctgtcttgccttaatgttcgtttctctcacctcaagccataaggtttgtatattacgttctaataattgttgaattaattctttcagtaattcttttcctaaccccaatccttgataatcaggatcgacggcaatattaaacaacgttgcctcatctaacacaagatgacaaatggcaaacgcaacaattttgccattaaccactttctttaaattaagataatgttcgccttgattattttttaatgtgcctaatgaccaaggaacaatatgtgctttttgttcgatcgcaaataattcggcaaaatcttgttcatcaatatatgaaatcattttctatatttcctgaatttgctgccaaaactgacgtttttcctgaggactttgctttaatctctcaagttcattacttttccaacaaggcatatattgcttatcgcttaaagtgcggtctattttctgttgatcgtttgtgagtaaccaataaatcacttcatgttcgacttgaagataaggcaaaaaatcaaagtcaatacataaacaatcttctttcattagctcaagactacgaaaaatatcttgtaaaaacggttgttcttttaaaaccggctgttcagaaatcataatcaaacgaatattttttgccacagagacatttaccaacccttttaaaatctcgggatggcgtaatttccactgtgaaatacccatttcttgtaagagtttatctcgtctgttcatttctattttcctaaataacaggctattttaaaccgtaaccgaaatgaggttaagcaataattgtgtccatttttagctcttggatttgatataaagtgaagaaactcaaccgtagaagatcaaacctaaataagaaatcattaaattagttttgaccttctacactccagtagaattttaattcaaactttttgttcgagaagaacgcttacgagaagatttaattttatgaattggagaaagcttcacaaaatcaactccttccgctggattttctagtgcaattgttaagacttcatcaatagtgtcaaccgcatgaatagttaaattatttttcacattttcagggatttcttccaaatctttgacattttctttgggtataatcaccgttttaataccacctcgatgagctgctaataatttttccttcaacccaccaatcggtaatactttgccacgtaaactaatttcccccgtcattgctacttcagattttaccggattaccggttaaacaagaaaccaacgctgtacacatagcaatacccgcacttggtccatctttcggagtcgcaccgtccggtacatgaatgtgaatatcacgtttttcatgaaagtcattagcaatacctaacttttcagctcgagttcttacaacagtcatcgcagcttgaatactttctttcatcacatcgcccaaagaaccggtataaatcaatttacctttaccgattacagatgccgtttctattgttaataaatcaccgccaacttcggtccaagctaatccagtcacttcaccaatgcggttttgtgtatctgctcgaccaaattcaaagcgtctaaccccaagatactcttgcaaattgttagaattcacttgaatagatttcaaacttttatctaatagcagatttttcactgctttgcgacaaattttagaaatctctctctctaaagaacgaacaccggcttctcgagtataatagcgaataatatctaaaatagcctcttcattgataaccaactcatcagtcttcaatccgttacgctcaatttgtttattcaataagtgacgtgtcgcaatattgagtttttcatcttccgtataaccggagagacgaatgacttccatacgatccagtaaaggtgctggaatattcattgagttggacgtagcaacaaacattacatcagataaatcataatcgacttcaagataatgatcattaaaatgtgaattttgttcaggatctagcacttccaataatgcagatgctggatcacctcgataatccattgccattttgtcaatttcatcaagtaaaaatagtggattttttacccccacttttgccattttttgaattaatttgccaggtaaagaacctatatacgttttacgatgtccacgaatctctgcttcatctcgcacaccgcctaatgccatgcgtacatatttacgccccgttgcattggcaatagaatgccctagcgatgtttttcccacacccggagggccaactaaacataaaatagggccttttaattgatttaagcgactttgtaccgctaaatactccaatatacgctctttaacacgttctaagccatagtgatccgcatctaaggtttcctgtgctttggcaagatcttttttaactttagttcgcttatgccaaggaacttgaaccatccagtcaatataactacgcaaaaccgttgcttcggaagacattggcgacatcatctttaatttttgcaattcggcaaacactttttcacgagcctctatcggcatcttagcctcttctattttcttgcgtaattgctcaacttcatcaactgtgttttcatcatcattcagctctttttgtaatgccttaatttgttcattcagatagtaatcacgttgatttttttctatctgttttttaactctgccacgcacacgttgttcaacttgcaatatatcggcttcgcttaccattaatcctaataaatattcaaaccgtgccgacaaatctcctatttctaggatattttgcttttcattaatagataccggaagatgagctgcaaccgtgtcacttaatctctctatatcattaatacgtcgcaatgcagaaataatatctgcgggaatttttttatttaaattcgcatatttttcaaattcggataaagtaattttcttcaatacacttaattctttctcatcactccattgtgtttcaattaattcgtgagacgctaagaagaattccccattatcttgcaaatcaataagtttagttctttgttgtccttcaacaagaacttttacagtaccatccggcaattttaacaattgaataatattgactaatgtaccaatcttataaagatcagcgatcttaggttcttcaatgtcaggttttctttgtgaaaccaataataattgcttattattttccatcgcctcctctaaactacgaatagacttgggacgaccaacaaacaatggcattaccatataaggaaaaactaccacatcacgcaatggtagaaccggaagatgctctagcttagttcgttttgcgttcatataatttactctctttcttaaaaatagactgaatgcacaggatatgggggctttttgttaaagttcaagcgaaacccaacctgctaaaacaatcaacatcattctatctaaaatgctacaaaacattccggcactttcttttgcttatttcgaagaaaattcaagcacctgttgtacgaagagtgatgtatctttagaaataaaaatctgcaccttaatcagttgtttatttactccaacttttagtgtgcagatcattttcaagtgcggtgtgtttttataaggattttactttttagggtgatccataaaacggaagaaatcactacccggttttaaaatcatcatattattcgaaccttcaaagctgttttcataggctttcatactacgcataaaactgaaaaactccggttcttgagcaaacgcatctgaatataattttgctgctgttgcatcgccttcacctcgcaactcttgtgcctttttacttgctgttgccaaaataaccacaactttacgatcaacatcagcttgaataaatgcggctttttctttaccttgtgaacgatgttcacgagccactgcatcacgttcagcacgcatacgttgataaattgaagaagatacttcatcaggtaaattgatctgttttacacgaacatctacgacttcaatacccaattcagcagtactatcttgtcctgtattcaatgctttcttcgcatcttccattaattcaccacgagtaccggatacaatgtctttaatagttctggagccaatttcagaacgcaaacgatcatttactttacggcgtaaaagattcgaggcttgtacataatctccgccactagtggctgtataaaagcgaccgaaatcactaattctccatttaacataagaatcaactaatagatcctttttctctacagtcacaaaacgatcaggttgaccgtctaaagttctaatgcgagcatcaaggattttgacgtgatcaataaatgggattttaaaatgcaagccagggctataaacaaccactttattatctgcatcacgatgtactttactaaaccgtagcataatgccacgagttccttcatcaataatcacaacacttgaataaatcagtgcgaccaatacgataagaataggagttaagaatttacgcattaattaaatctcccttgacgaccttctataacttgataaagactgttcggttgcgaaatttccggatttgttaccgctctttcaggaacctttttttcacttgattgatcagttttaacgagcgtattgcttttctctgctaacgttttactattcaagatctgctctaacggcaatacggttaaattatttccactctgtgtatctaacatgactttcggtgtattcgccatgactttttccatagtttgaatatacaaacgttcacgtaataattccggcgatgctttaaactcaggtaataaacgttggaaacgctctacttcaccttgtgcatccaacacaacttgttctttatatgctgtcgcctgctcaataatacgttgtgcatttccacgagcccgtggctcttgctcacgagcataagcttctgcctcacgaatatagcgttgctcatcttcttgagccttaattgcatcatcgaaagccgctttcacttcctccggagggcgagcagactggaagttcacatcaatcacttctaagcccatatcataaacagcaatgatatcatttaaagttttccaagtattttcacgtacaactgaacgtccggtagttaaaatatcatccatcgtcatatgaccaattacataacgtaatgcactatctgtcgcttgatttaaactgtcatccgctctcgttacactaaacaaatatttcgccggatcttgaacacgatattgcaccgtcatctcaaccttaaccatattttcatcttgcgttaacattgaaccctgtgttcttaattcacgaacccgctcaacattcaccgctgttacgctatcaataaacgttggtttccaatttaagcccggctgaacgattgaatgtaattgtccaaaacgaagaactacaccacgctccgcttcttttatggtataaaacccgcttaatccccaaatcaccgcaccaatcaatacacctaacggtaacaatttacctaaccccaccggagaatttggcttgccgttttttccgacattaccggatttaccactgatttttttcagcaaattattaaagatctcttcaatatccggcggtgattgttgagtattcttttgttggttattcggctgctcccaatttgactgtttatcttcattatgggattgattattttccggttttttccccgtgctacccggcttaccccaaggatcttgatctgaattattgaacgacatttcattctccatttgtcaaaaattgtgacaagtctaaacaaaatattgatctaagtctaatttatttaaaactaattttgcgatttatttggtattcctcacacaaaagcaaaaaaataactcatttttcaaactctgtaatgataatcaccgcacttagaggtaacaacacagaatgatgaaaatcacctttcaaacgaatggataagaacaaaaaatagttatttaatagcaaaaaattcagaatgagaaagttattcagaagtgataaaaatcgccgaataatcggcgattttgtataaaatgaatcaatctaaccgtttagacatagctaaccaatcggctttaaattcacgacgcatattattaattgcatcaataatatcatgatgcaccaattgttcattttggataccgacacaataaccacctttgccctgtaataaaagatctacagcgtaaacccccatacgagaacctaaaatgcggtcaaaagcacaaggcgtaccgccacgttgaatatggcctaaaatagttgctcgagtttcgtgttttacacgggcttcaatttctcgagccagctcattcacatcacataataattcagtgatggcaataattgcatgacgcttacccttaataatggcacgctcaatttgcttaattaattcttcacgattaaattcaatttcagaagcaacaatatattcacaaccacctgcaatagccgccgagatcgtcaaatcgctacaatgtctgcccataatttccacgatagaaatacgcttgtgtgaacttgaggtatcacgtaaacggtcaattgcctcaactgcggtttcaagtgcggtttgataaccgatagtataatcagtgccagcaacatcattatcaattgttccaggaataccgacacaagggaaatcatgttcttcagtgagtaattttgctcccatataagaaccgtctcccccgatgacgaccagtgcatcaataccatgtgaacgtaaaatttccacgcatttttcacgtacggcaggatctttaaactcagggaaacgagctgagccgaggaatgtaccgccccggttgataatatccgatacgctatagcgagttaattgttggatcttgttgtgatataaaccgtaataaccttcataaatcccataaacttccaaaccctcggataaagccgaacgaacaacaccacgtatcgcagcattcatccccggtgcatcaccgccacttgttaaaactgcaattttttttatcatattacttacctaatgtattgttaaaattaatcttcaaaaaaacagtgccaaggttacactattccttgccgtcgctctataaaaatttttgtgaattgcaacacaatttgatctagtttaaacttttcagctcaacttgaacaacgctggttggctcttgatgaatcgcaatatcagtgtaagaaaatcgctgtctcaattgattttctatatcttccgtaatttgatgagcttgaagaaaagacatatgatcatctaattctaaatgaaattggataaaacgaaccgcacctgaacgtctagttttaagatcatgaaaacccaaaatacgtttatctgctaaaataatttgttctatgcttttaatttcttcatccggtaaggcaacatctaaaagcaactggagattatcaaacaagattttacctgcattaatcaatatataaaaagcaattaaaagagcaaaaatcgcatcggcttgttggtaacctaattggctcaacgataatgaaattaaaatagtaaaattcatcaataaatccgtttgataatgaagtttatccgctttaattgccggactgcctgtttgtttaatcactttgctttgatatatcactaacaatgcagtagctaaaatcgaaaataaggttacaaaaacaccaatctgaaaattcatcaagggttgtggtgtatttaagcgatgaataccttgcagaagaataaataccgccgatccggaaataaatgcactttgccccaaaccagcaagagcctcagccttaccatgaccaaaagaatgattatgatccgccggcatcagtgcaaaacgcaaaatcagcatattcatcaaagacaccaataaatccaacattgagtcagtgatagacgctaacatactgacagaactcgtttgccaccaagcgaaacttttcactaaaattaataataaagcggtaaaaatagctaaattggctgcttttttcacttgttgggaataaatacgttccatttatacaattaccctcattgataacaaccgactattttatattgttcgagctgtgcgatttctttatccacaatatatttttttaaatagcgttcaattttatgtttactcattgctgatgtgggagctttcattaacttaaaagaatattgatattgaataaaaccacaaaaaggaatctctttaccttttgcaatatctacttgccaagttggatttttttctgtcggttcataaatcacaaagctgtaaagctcattatctttcaaataaagattaaattgcttcacaccgttattctgataaacatgtcgtctcaatgttatacgatccgacaaactacgtttttcacgattacgatcatgtaataattcaaccgcactttgccagttttcaacggtatgctctttcggtaaataaaagtaacgagccacagtttccaaatctatcgcactgacaagataataacttttttcatgatgcttaatatattccggtacgtttactcgagagtgtgatacacaagccgacaataaaagtgcggtcagaacagctaatattttgttcatttggttaaatctcgtttaaatacaaattctgtttgtgttgaagaggatggattaaactgatacccccctaaatcaaactcttttaattgttcaatgtcagtgactcgatgttgaataatatagcgacacatcaaccctcttgcttttttagcataaaaactgatgactttatattttcctcctttgttatcaaggaaaaccggcttgataattttcacctctaattgattttctttaatggatttataatactcatctgaagccaaattaacgagaattctatcgccctgctgttcaattgcctgttgtaatgcgtcggtgatgatatttccccaaaaagcatataaatccttgcctttttcatttgccaattttgttcccatttctaaacgataaggttgcattaaatcaagcggtcgtaacactccatataatccggataatacacgcaaatgctgttgtgcaaattgaatatcgtcccgacttaatgtttcaacctccaagccggtgtaaacatcacctttaaaagcataaattgccgcacgagaattttgttcattatgctctatttgccattgttcaaagcgtgcggcatttaagccagcaagtttatcgctaatcgacattaacgaacttatttgttccggtgaaagttgacgacaaatttttatcaatttttcgctatatgcagttaagtgcggttgagaaaaagcaaaattcggtaccgcactttcccaatctaacgttttggctggagaaataatagctaacatgttctttcctcaaatttatatcgtcattggcaattgccaattaatttcagttaaattgtgatgtcgtaaatactgattggttttggaaaaatgcctacaaccgaaaaatcctctatgtgccgacaatggcgaagggtgtggcgaggttaaaacacaatgcttagtgcggtcaataaattgaccttttttctgagcatgactaccccaaagcaaaaaaacaagatgatcacgttgttcatttaaaacatgaataacacgatccgtaaacgtttcccaaccaaaattcgcatgtgaatgtgctaatccctgttcaacggtcaacaccgtattgagcaataatacgccttgctttgcccaaccgaccaaatagccatgtgaaggagtttgaaaccccataatatctgttgagagttctttataaatatttaccaatgaaggaggcggtgctatgccgggtttgactgaaaatgccaacccatgtgcttgattgacaccatggtaaggatcttgacccagaatgacgaccctaacctgatcaaactccgtcagtctaaaggcactaaatacttcttcttgaggtggataaattgttctaccgctttgtctggcttgttgaacttgctgtaaaatatgctggaaataaggttgttgtttttcttgcccaattgcctctttccacgtattcatgattttcctcatattgatatgccaatcttaagcggcaattataaagaaagaataataaaatgcctagtttggatttgcttaatacgtataggttatttttaaattttgctgattttaacgccttgattacgtttcaatccaatatattttttcaataaaattaaaccgctctatatcaaattaattgaaaatataaaattttttgataaaatttgcaccagttcaattcgtgaaaaaacataatgattaggagcatattatgattaaaggtatccaaattactcaagcggcaaatgacaatttattaaactcgttttggttgttggacagtgaaaaaggcgaagctcgttgcttagcggctaaagcggaattcgttgaagatcaaatcgtggcagtaagcgagttaggtcaaatcgaatatcgtgaattaccggttgacgttgcaccaacaattaaagttgaagggggtcaacacttaaatgtgaatgtattacgtcgtgaaacattggaagacgcagtaaataatccggaaaaatacccacaactaaccattcgtgtttccggttacgcagttcgttttaactctttaacaccggaacagcaacgtgatgtaattactcgtactttcacacaaagtttataatttccatctgatctgatgtgccgtattcccacatactttaaaacgtggaaatacggcacaaaatattctcgtcgactttactctccgatcttaccttattttttattgcaacaccgaaatgtctgctacttgtaaaaagagattttgtagcgtgcttaaaatcgctaagcgattttggcgaagcgtttgttcttccacatttaccattactccgtcaaaaaacgcatcaatcggctgacgtaaattcgctaatttatccaatacagccgtgtagtcgccttgtgcaattaacggttgcacttcgccttttaaggcaataaccgcttccgccaacgttttttctgccgactctacgcaaacgcctaaatcaatctcaccaatcgcaatatcggctttcgctagaatgttgctcacacgtttatttgcggcggctaaggcttcggcactgtctaatgtacggaaatgagaaaccgcacgcacacgagcatcgaagtccgcaggtttggtcggacggcgagccaatacagattgaatgacgtctactgcaatgccttcactttcataccatgcacggaagcggccaagcataaagtctactacttcatcaaccacatttttattcgtcagtttgtcgccaaaaagtgcggtcgcttttgccacaatgtcaactaaatccaacggcaagtttttctccacaataattcgcagacaacccagtgcggcacgacgtaaagcaaacgggtcggcactgcctttcggggattgtccaataccgaaaatccctgtgagcgtatcaattttatccgccaatgcaacagaacaagcgactaacgaattcggcaatgtatcaccggcaaaacgtggcatatattgttcgttcaacgcaaccgccacgtcttcatcttcgccatcgtggcgagcatagtgcatacccattacgccttgcgtatcggtaaattcaaacaccatattggtcatcaaatcgcattttgagagcaagccggcacgtttcgctttcgtttgatccgccccgatttgtgctgcaatttctcctgctaaggcttcaatacgagcggttttatcacgcaatgtgccaagctgctgttggaataacacggtttcaaggcgtggcaaccgatcttccaatttctgttttaagtctgttttgaagaagaattccgcatcggtcaagcgtgggcgaaccactttttcgttaccttcaataattttgctcggatcgtccggattaatattggacacgaagataaagtgcggtaataattttccgtctttatcataaatcggaaagtatttttggtcgcctttcatcgtataaaccaaggcttccgcagggacggcaaggaaacgttcttcaaatttagcggtcagtacattcggatattcaactaatgacgttacttcttccaacaactcttcttcaatatccgccacaccgccaagtgcggtcgctttttcttgagatgttgcaaggatcaacgctttacgttcattgaaatcggctaccacagaaccacgttctttgagcaattgcggatattgatcggcgtgatcaagactaaattcacgctcacctaaaaaacgatgtccacgaacggtacgcccgctcgccacgcctaaaatttcgccttcaatcagatccgcaccgaataaaagcgttacggtatgcaccggacgtacaaactgctcggttttatcgccccaacgcattgtttttggaattggtaatcctgcaagggctttatcaataatgcctacaagcaagtttttagtcggctgaccttcaatcactgcacgatgcaccagccattcgcctttatcggtggcaagacgttcggcttgctcaacggtaatgccacagcctcttgcccagccttccgccgctttggtcggcttaccttcggcatcaaacgccgccgatactgccggcccacgtttttcaacttgtttgctcggttgagcctctgccagccccaacacttttactgccaaacggcgaggggctgcaaaccattccactttctcaaaagccaaccctgcttgatttaactcttgctcaacattctccgcaaatgcggtcgctaattttttgagtgcctttggtggcaactcttctgtgccgatctcggcgaggaagttttgtgctgtcattgttatttctcaactatacgttttatttaaatccattggctaaacaaattgctttgttcgttttttggggtacttttactcaattcttcacatcgtttttacgtctaccaaattccctaactcaataaaaatcaaaaggttacgttttacttgatatcgttttgaactcattttcttattctacactattttagatagaggcaaaacaagattgcttttgaaaacgctcaatttgccttttcgttgtactgagttttaacgttttaaaaatcaatctaagctcatatcaaagtaacccagaaaagaaaaagaaaaagaaaggataaaaaaaagagaagaattttattttttttgcgataaatttagacaattttgtagcaaatttataactagatcagtataatcgcacacttaactaaactggatttaatcatttgagaaaataactcaaatcaaccctattaacattaatcgaataagaagcagaatatgagcctacagcctacagcctacagcctacagcctacagcctacagcctacagcctacagcctacagcctacagcctacagcctaggctaacgcctttttataaaccttgcaaaataaattttaaaaagtttttaacttctcgtcatacccaaatttccccttttaaccccctttgcgaagatatcattcgcctttttctgctttgccttaaaaagcaaggtattgcctatttagagttatcccctctctctaaagtttaataaataatcagtaagagataataaataaacaatcaataacagattcgatcaataaccatttaacaagtcattcaaagataatttttaaagcgagtaattctatgaacaaaatatttaaaactaaatacgatattacaacaggtcaatgtaaagccgtttccgagttagccagcaatcgccaaatagcaagtagttcggagagtaagccgaagtgcggtgtgtttttcggtggaaatttaggggcgtttaaggtcctgccgttggcgttggtacttgcgggattttttggtgtgagcagtgtttcatatgctgatatagtatatatagatatggatggagaaacaggagctgcgggtgtaaaacagaactggtctgaagcaacgtattggaaagataaaaaaaatattttgataacccctgttcaagataggggtcaaattttaaagagatatggtggaataaatacaaatgtagaacactctgtaattataggtcctaactcggctgggagaaaccataaacaaggtatgacgatattgggctataatgcagtcggttacgaaagtcaagcaacagctttaggtaataatgtatattcagctggacaaggtgtagcacttggatcggatgtaatggctgcgggtcttggttctatagcaatagggaatgatgatatatatactgatgttggattttcagatacgttgcctgaagagactattttgaaaatttatggatatcgttcagatgattcaactaatgttaagtataaaggtaagattagttataaagatatattagatgaaaatgactttaagaaaaaatacgtaagagataatcatattgataccagagtatactcccctacttattcagccggagtggcggcaatcgctatcggttcaagatcagttgcctatggagatacctcactgtctatcgggacattatctttcgccttaggtaagagttcaacggcggtcggtgtacgtgcgtttgtggattttgtcgcaacaggtggggttgcgatcggagacgaatcacgggtatttgccgcgaattcctttgcggtaggaaataatgccgaatcaacgaataaaggggcgttatcctttggtagtttctcaaaagcagtaggtgagggttctatcgctataggacaaaatgtagggtctaatgccaagttaagtggtagtgctgacaccgaacttgaaaagttgattatgagtactacacaaactgctcaacctaccgtatcccctggggatcatggaagtgcaactattgcatatgacaatagatcacctgataaacaattaaaattcggagataagaatgagattgttacacttggatttgctgcaaaaaaccaaacagaaaatccagtttctaagctaattgatgagctaataaagaaaaaagaaaaacaaaaagatcagctacaatatgcttttgacaaaagcaacggcgagatcatcgaaaccactgaaaaaatttataaaactcaaaaagaaggcgaccatgcgatttcgctgggctatcatatttccaacaacggcgataataccattgcgatcgggagtgcttccatcgtcagaggatcgaactcggtcgttttgggggcattaaataacatcggtaaatatgcacgaaataccatcgcacttgggattggtactaatgtatataaagaaaactctgttgctatcggtacgggggtcaatgttgccggtgcgggcgttgtggctatcggttctggcgttggtgtaacgaaagataacaccatcgccgtcggctatggtgcccatagtttatcaagtgaaagtattgttttgggaaatgatgcaagcctaaaagaccatgcttccgaatctatcgtcatcggacaccatgcacaagttgagcataaacttgatgaatcagctaaacaggagaaaatagaaaaagtaaaacgagataagaggatatttttagataacggcaatgtagaattagagatgtccgccattgcgataggggcagactcaaaagtttatgctgaaaaaggcgtagcattcgggaataatgcacaagttgagcaaaacgcaagcagtgcgatggcattaggtaatgatgccgaagcgacgatgaaaaactccgtggcgttggggtataaatccaccaccaaatatttttatgaggacaaaacgggcaatactgcaactattacttcatcaaacggaccaaccgttaaaaatgacagctctaccaagaccgctacgttagacgggaaaaaagccattgagttagctccctatattccggaggggtcaagttacgatttaaaaaccgatgaagcagcgggtattgtgtcagttggttggattaaaaatggaagtaatggtggcggtcaagaacttggattgagaagaattgtcggcgtcgcaccgggtgcgttggattctgacgtggcgacgattggacaattaaaagccttagcttatgtgaaaaaagagggggtggtaacctactataccgaagagaacgggaacatatataaagtcgttaaagacacgaaaggcaatttttataaagtcaatacggataacggaacgccattagatgatacgcaaatagataaaaacaaggtttttgccggtccaaaaggggcgaatgaaaaacctgtcatgataaatggcaaaaaaaccgcagatatgggcgaactaattaaatttggtcatatagctgatggagaaattgctgacaagtctaatcaagcgattacggggaatcagctgaatcagcttggtaaaactattttaggcttgaccgtaaatagtgataaaacaaaatttgatacgcctagttttgtagcggttaattatgaaggagcacaatccggaacaaataaccagccaacaacatttaaaaaagccattgatgaactgattacggcagtaaataaagggcttaacattgcaggagatgctgaaagcggacaacttaccctaggctcaactttaacgattaaagcggggaatacaacggttgaggataaggtactcaaaacaacaacagaatataaaagcgataatattagaacagcctatcaatcgaataacaaaacacttttaataggcataaaagaaaatccgacatttaaaaaagttacattgtcagaagaacaaacctatccttctggtacacaaaaaaatacagtcgataaaaacgacttaattactaaaggctatttagacggtgcattaaaaaacgtcgctacgagttttaatgtccaaggggattcaggggctaaatttaaagtccaagatactttaaacattaaaggagcagacagcacggcacaaactactgatcaaagtgcggggacaacttctacagctcataaaaatatcaccactaaagcctcaagcgatacattagaaattgctctcaatgaggacataaaagaggttaattccattgcgggcaaaacatttatgaccaagggtagcaatggtaagcaaacgcctgtaagctcttcaattgaatttaatggaaaaaatgtaaatggtaccaaagccaatactaacgttgtgattaaatccaatggtgcaaattttgtatttgacagaaccggcttaaccttaagcggtaaacagattaaaggcattacaagcggtttagggttaaatggtactggaaacggaaatgctgacattatcgacaaagtccttgctggaactcttgatagcacaaacagcggtggcagtagcacgacaattgccaacaacgccgtcaatgtgaaagacctgtccgaagtcgctaaagcgattgttcaaaaaggcttgacctttgcagggaatactggcactgacgttaaagcctcactcggcgataaaatcacgattaagggcgagggaacgtatttgaccagcaaggcttcttcaaatggtagcggtaaagaaattacattttctttgacggataaagtaaccaataaattagcgataatcaatgtcggcaatgggtctaccaacggcgataattcctttgcgttgggtaaaaattctacatgggaagggaaaactaccgctgcgaccagtgcagatattaatgtgggttcagcaagtttgaaatttgactggaacaatgcaggagcaggggcggataaagaagttgtcagtgtgggtagtcaaggcaatgaacgcataattaaacatgttgctgctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcgaaatcggtcgtggcgacactttgaagtttacgaacggacagaatatccaagttactgtagcaaatggaaatggcagtgcaacacagccaagttcgagtgcttctgcttctgcaccggctccaacaccagctgctccagcaccgtcgcctgctccagcagctgcaccgccgtctgcttcggcaagtagcacaactacaacaccaaccacgagtacaacaacgactggtacaccaaccgcacctactacggctgttgttactatagcgacgactgacacgttagaaaatataaaatctatctcttcacctaaaggaagtgcgggcggaaatggtgctggttcaaatgaagaagtcaccaaactttctttaacttcagaaaatgccacattccaagttggcacaacgggtgcgaaagtgaatatcaataaagagggtattgcacttatgccacaaggggcgaataacacaggcggagcaaatggagcaaatccatttgctgatacagcatcaatcactattaaagcaggtgcaaaaccggcggatccaaaaagtttagattcacttgatcctaataacggaccttcaatagagttctcagccaagaaaacaagtgatggtaaatctattggcacaggaaaaatcaccggtctgaaagatttagaagcaaattctgacggcacgagtgcggtgaataaaaactatgtggataaactggataaagtgacggtgaaatatgatgatgaacataaaaaatcaatcactttaggcggtaaacctcaaaatggaggtaaggctcatgaccctgttgccatcaacaacctcaaatccggtttagggcttgatgatatgaaagataaaccggattctcaaaaaaatggattaagttttgaactagtgaaaaaattagttgctgagggtatgagcggtcagcaagggcaacaaatgacaaaagatgacctacacaaagccgccaatctcgctgatttaaaagcggttgcacaagctgggttgagatttaaaggaaatcagggcgatgatgtggtcagaaaaatcagcgataccttaaccattaaaggggaagaaaacgctacaactggttctagtgccactgacaagtttaacagtacgacaaccgccgctggtaacattaaggtagaaaccaatacagccaaagacggcttagaaataaaactgtcggataccttgaaaaatatgaaagcctttgaaaccaaagaggagggcggtaagaaatcgacgttaaatagcgagggcttaactgttgagaacaaaggtaaagatggcaatagtaaaggtacctctgccacctatggtgcggacaatatcatgttggaagataaaggtaaaaacaataaagcaacaataactgctgaaagccttacctttgctgacaacgtagcacaaaatcagcaaaatccaatgccaaaaaccgttcttaataaaaacggcttaaccgtaaccggcaaaggcggtgaaattaagattgatggtgaaaacggtattattaccgtaccggatattaaaccaacaaccagtggaagtgcggtggtgaataagaaatatgtggatggtcaactcagtgccactgtcaaccgcttggataatgtgatcagtgccaacaacaaacgcttgcaatcaggaattgccggtgcaaatgcggcggctgcgttgccaacgattgcgatgccgggtaaatcggcacttgcagtctctgcgggtacctatagagggcaaagtgcggtggctttgggctactctcgtgtgagcgacaacggtaagattatgctgaaactacacggcaacagcacctcaaccggcgatttcggtggtggtgtcggtatcggctgggcgtggtaagctgaggtcaaactatcaaaaaaagcagtgataatctgttccttagtcagttgttttttttatccaacttctaggtaaagatcaaaatcactgcttttttgtttgttggtgcggtatttgcctgagagcaatgcatgataaaaaatagtcagttaaatactgaataacgatgccataatgtataggtgaaatttcgagataaaagcaaaaatctattacatcatttcattactaataaatttagcgtaaaataatgccatctataattacatagcagaaataaaaatgagcctacaagcctacaagcctacaagcctacaagcctacaagcctacaagcctacaagcctacaagcctacaagcctacaagcctacaagcctacaagcctacaagcctacaagcctagtatattggctaaaaacaaccttgcaaattcattatgaaaggttgttaatgtctaaacaaaaatccaagaccaatcaatctcaatctattactcaaaatagttttcgtttttttgatgcctataaatcattcatagatttaaaagattgttgtttatttctcagaacgaacgatatcaatactattggtatgtttgcagttaatgtacttgcatttcctcacaaaaaaacaccgcactaaaataagatgttccgagaagataatatgaatttaattatatgctgtactccattacaggtaatcatcgccgaaaaaattatcgaacgttatcctgagcaaaaattttatggggttatgttagaatcattttataacgataaatttgatttttatgaaaataaattaaagcacttatgccatgagtttttttgtataaaaattgcaagatttaaactagaaaggtataaaaatttactttctttattaaaaattaaaaacaaaacttttgatcgtgttttcttggcgaatatcgaaaaaagatatatccatattattttaagtaatatctttttcaaagaattgtatacttttgatgatggtactgcaaacatcgccccaaatagtcacctctatcaagaatatgatcattctttaaaaaaaagaattactgatattctattacccaatcactacaattccaacaaagtaaagaatatatctaagctacattattcaatttatcgttgtaaaaataatattatagataatatagaatatatgcctttgtttaatctagaaaagaaatatacggcacaagataaaagcatctcaatactattaggtcaacctatattttatgatgaagagaaaaatattcgattaatcaaagaagtcattgcaaaatttaaaattgattattattttcctcacccaagggaagattactatatagataatgtttcatatattaaaacaccgcttatttttgaagagttttatgcagaacgatctattgaaaatagtattaaaatatatactttttttagtagtgcggtattaaatatagtaaccaaagaaaatattgaccgtatctatgctttaaagcctaaattaactgaaaaagcatatttagattgttatgacatattgaaagattttggtataaaagtgattgatatttaaaatttttggcaaaaaaaaataaataaatgatcttaaattaatccgtaataatgaacttcattattcactttataaagcaagctgaggagtaaatgttacggtaagttcaaccagttcatctaaagaaattattttcatttgcggtaactgtacaaatattttctcacttaaatttcttgcctcaacatcaggttgtaaaaacataacaggtatattaaggcaagcaaaaagttgagggtgctttaagggtaataaaacagcatcttgccataaaactaatacatcttgtggtgtgatttggtctaaataaccggttaattcatttatgtcgtagcttgattgagaaaaggtatagagcatattatttatccctaaaaagttaaaattttctctgcctgatttagtttttgtagcaacaaagtgcggtcaattttttgacaggaaataataaaatcttggctatttaattgatatttttcacaagattgccgacaaatatagcgttgctcgatttcatacaaatccaataatttaaaggtactaatgaaatctttttgcaaaataatttcaggtttctgctgattaagtaaattaaaaacaccatcttctaagaagaagagcgcaatttcatcttcattacaaaatgccgttgccgccaacagtgcatctaaaccttctcggctgatactgctaccgtgtggtgcttggcgaaagataaaagccagttttatcatattgttatcaacctatctgcttgcaaaactgccttattaaactctcctaatcctgccaaaataaaaccttctgctaaattattttgttgctggttatttgaactcagcggttcaacgatacctcgccgttgtgctgctgaaatacaaagatgcaatggaacagaatatgtttgacttaactgttgccatgctttttgtaagtgaaattcgtcatttgccggattaacaaaggcattacctaaagttaccccttgttgaaaaaaaaagatttgttcaatttgatgacctttcgccaataaggtttgtgcaaattgataagcaagatatgccccttgtgtaccataaacaggctgtttaaccgctaaaacataacgcattattctattccttgctcttgtttgagttgacggatatagagataaacggtatgtcgagagatatttaagcgttccgctactaaattaatcgcatctttaatatcaaaaatacctttttcatataaggacaggacaatttgacgatttttgttatgatttgcaacaagacgatccgctgtaatttcttcgatagtttgttctatagtttgaacaacaagctcctctactgaactggcgaaattaactgctgacatttccacttgttcaggtgcgggcatcaatgcctgaataaattgagacatgggaatatccaaattaatattaatgcaaagtaagcctataatgcgttgattaccgttacgaattgcaatcgtcaccgatttcatcaatcccttacttttagatcgagtaaaataaggtttagacacactctcggtttgcatattgtgcaaagacgttaatgcaaaatttgtaatcggcgaccccacttggcgattggtattatgtccattggcaatacaaatagccgaatgctcaaggtcttccaaagagtgtaaaacaatttcacagtgctcaccaattaatgcactaatcccctcaaccacagcgatataagaattgagaatagtatgatcttcatttgtaaaagggcgtctatccgataacatgcttaatttcccttatttttctcaccgcactttaggctatttttaatgtaagtgcggtgagttttactttatttttcagaagttacatctaagatttcaatatcaaaatatagcgttgaactcggtggaattagacctgcacctctttcgccataagctaagtcggcaggaataaccaactcaatttttccgccttttttaatgaattgtaaaccctctgtccaacctaaaatcacttgatttaatttaaattcagcaggttgtccacgctctctggaactatcgaatactttgccattggctaatttgcccgtgtaatgtactttaacacgatctgtcggtttaatgctcttaccttctcccattttttcaatacgataaagtaaaccgctttccgtttttttcacattcgattttttagcaaattctgctgtaaatttctcattttcagctttgattttagccatttttgcatgacgtgctttgttttctaactcttgcaacgtttcttgtgctttttcatcagttaaagtgcttttattttctacaacatctttaatgccagcaacaattttctcataattgtaactggcaacatctttgtgttcttcacccatcaccgttaaatattttcccataaaatagcccaaagcataagaaacatcatcattgaactgcttatcagcaaaaacagattgagaaacgaccgcacttgctattaacgctattgcagaacgttttttaatttttaacatttttcttgatcctttataataaaaatatgaaatgttgaatagattaaattgtcttgttcaaatgcacaatcattattttttaattagagactatttatgccacaaactcaagaattagatcaacgtattgcagaattagaaatgaaaattgcctttcaagaaaacaccttagaagaattaaatcaggcattaattgatcaacaatttgttttagacaaaatgcaactacaattacgctatatggcaagcaaattaaaggatttacaatcttctaatattgcaagtcaagcggaagaaacacctccgccacattattaacttattgataaacatcaataatatcaagaggataggttttttcggataaataatcttccacggcttgtaataccaaaggattgcgagccgcttgtccatcttgctgaatataatggtgaaactcctccaagctcaaccaaagccctccggaaatatccggatcagaaggtgttatctcaacccaatctgttaactcaacagaaaaaacaaaccgtaaataatcagttttagaacgaggtgcatgccattggtaaatctttaataagttttgcatctctgctcgaataccggtttcttcaaataattctctttgtgcaccttgtaaaatagtttcatttttttctagatgcccagctggttgattaagcgtcattttgccgtattcaaattcttcgacaaataaaaatttgcctttgcagtgcacaacacaagccattgtaatatttggtttatacatattagatactctttttaacttgttgatataaatcttgtaattcggttaacgtaagctcacgaaattgtccattggctaaattggtgagcgttagccccgctgtttcataacgaattaaacgcaatgtgggaaaaccgatatgggcagtcatacgtcgtacttgacggttacgcccttcgctaattttaatttccagccagctggtaggaacagttttacgctcacgaatcggaggatgtcgttgccaaatattcggttcagaaatcaaccgcacttttgccggtttggtcaatccatcattcaattcgatgccttttctcagctgtgcaagatcggtttccactggaatgccttctatttgtacccagtaggttttttccattttaaattttggattcgtcagtcggtgctgtagctcgccattattggttaacaataaaagaccctcgctatctcgatctaaacgtcctacgggataaatgtgcggtatttttataaaatcttttaatgttgcccgcccttgttcatctgtgaactgacagagaacatcaaaaggcttgttgaataaaatcactttagtttgtgcaaagttaagtccccttttttgcctacgtttcagcaccgcactttttacaagcgattttatcaagttagtgttgtttaattttttgcgttgaagatccatgttttagataaaaataaataagggcaagccattagctgcccttatgctgattagatttttgccaaaatattattcaatgttgctgaaggacgcatggcttgtgctgtagccttggaatcagggtgataataaccttgaatattttgcggcgtcccttgtgcagcaagtagctcttgattaatttgctgctcattttcttgcaaggcttgtgcaattaactcaaacttcctattaagttgttcatctttgttttgcgctgctaaggcttgagcccaatacattgccaaataaaaatgcgatcctctgttatcaatcgtccccaatttacgtcccggagatttattcttatctaagaaaattgcatttgcctgatctaatgtttctgccaaaatttgtgcttgatcgttattttgcgtttgagcaaggtgttccagtgaagcttgtagtgctaaaaactctcctagtgaatcccaacgtaaataaccttctgcaataaactgctcaatatgttttggtgcagaaccgccggcaccagtttcaaataaccccccaccattcatcaatggtacaattgaaagcattttggcagaagtacctaattctaagattgggaataaatctgtaagataatctcgcaacacattaccggtagcggaaatcgtatccaacccttgacgaatacgatttaatgaaaatttgcaagcctcaatcggagataatattttgatgtctaaatgtgttgtatcaaattcagccaaataagaccgcacttttttgataacttcacgatcatgtgcacgattttcatctaaccaaaaaacaaccggcgtattggtaacgcttgctcgattaactgcaagtttaatccaatccttaattggtgcatctttcgtttgacacatgcggaaaatatcgcctttctccacatgttgcaccaagtaaatttcgccatcttcaccaaccacttgaattaccccttgctcttcagcttggaaagttttgtcatgtgagccatattcttccgctttttgtgccattaatccgacattaggtactgaacccattgtagtaggattaaaagctccgttatgtttacagtcttcaatgaccgcactataaatccctgcataacaacgatccggaatgagtgccaaggtatcttgtaattccccttttctgttccacattttgcctgaattacggatcattgccggcatagaagcatcaacaataacatcagaaggaacatgcagattagtaatccctttatctgaatttaccatagcaatatcaggtccttgctccattgctttttcaattgccgctttgatttcattttccttggcatggccggcgattttgctataaagctcacccaacccattgttcgggttgatgctaagttgagtaaacacatcagcatattgtgcaaaaacatcggcaaaataaacagaaacaataacaccgaaaatgataggatctgatactttcatcattgttgctttaagatgtgttgaaaataacgtaccctccgctttagattgagcttttgcttgtgctacaaaatcttttaacgcttgtaaactcatcactgaggcatctattacttcaccagcttttaacggtgcaaattttttcaacactttcttttcaccgtttgcagccacaaattctatttgaaattgtcccgcactttttaccgttacggatttttccgtaccataaaaatctccttgttgcatgctgacaacttgggtttttgattgtgcagaccaatcgcccattgagtgcggatttttctgtgcataatttttcactgcttttggtgcacgtcgatcagaatttccctcacgtaaaacgggatttaccgctgaacctaatacttttgtgtaagccgcttttatttttttttcttcttccgtctgtggttctgttggatagtcaggaacagcaaatccttgttgttgaagttctttaatggcggcgttaagttgaggaatagaagctgagatattcggtaatttaataatattagcttccggtttagtcgccaattcacccaattcagcaagggcatcaggaattttctgttcctcactaaggtaagcagataaattggctaaaattcgccctgcaagagaaatatctttggtttctacatcaatatttgcgacagcagtaaatgcttgcacaattggaagaaaagaataagtcgccaacattggtgcttcatcagttaatgtataagtaatttttgctgacataggcatgttcctgtatagatatgaattggttaattggaatgaatttgctctttatggtattagagcgttctaagcataacaaaaaaataacaataatgttattttatgcgtacaattttttcaaaatttaaacaatatctggaaagaatatatacagataaatgatatttatgtcataatccgagcgatttcgttttttattttaggagctattatgtcaaaaccattaaattttgtgatgatttctccacattttcctgcaaactttgaaacttttgccgttcgtttaaaggagtgtggttttaatacattaggtattgcagacacaccttatgaacagttaagtgaaaacttgcgtagttccttaacggaatattatcgtgttgataatatggaagactacgagcaagtctatcgtgctgttggttattttgcacataagtatggtcgaattgatcgtattgaatctcataatgaatactggcttgagcttgatgcaaaattacgtacagattttaatgttcctgggtataagaacgatgatatgttggcaattaaaaccaaagcacaaattaaagaaatttttcgtcaagcaggtctgaaagttgctcagggaaaagtatttaactctgatgatgaagcacgtaagttagctaaaaaattgaagtttcctgtgattattaagccaaattcaggagtgggtgcaagcgatacttataaaattaagtcggtacaagaattagaggactttttttcttataaaaatgcacacgttgaatacatcatggaagaatttattgatggggacattattacctttgatggtttaaccgataaagagggcaatattgtgttctattccggtcttgaatattccgagtgcgtattggataccgtagaaaatgataatgatatgttctattacgttcctcgagaaatttcaaccgacttaattaaattaggacaaaaatgtgttgatgctttcaacgttcgtgagcgtttcttccattttgagtttttccgtgtgaaaaaaacaggtgatttgatgccgttagaaatcaattgtcgcccacccggtggcttgactattgatatgtggaattatgcaaatgattttgatgtattcagagaatacgccaatattgtgaaagaaaataaattctacacaaatattacacacccatggaatgtggtatatatctcacgtaaagcaaataagaattatgtaaactccattgaagatgtgcaacaaaaatattctactaatattattagtgtgcaaaccgtacccggcgtttttgccaaaattatgggggaacatggtattttagctcgcacagaaactttagatcagatgcatgaaattgcacaatttgcacaacaaaaagcataactttgttttaatttatagacaggatttccctgtctactgtaacttttaggaaaaaaataaatgcactttgaaagacgtagccattggagcggtgaattgggacgtgaaatgcactttaatgtgtatggtcatgcgggtaagcctgtgattgtatttccttcatccggtggaaatcaaaatgaatatggtaactttggtatgattgaagcttgtcgttcttttattgagcgtggcttaattaaattttatacacccgactctttcgataatgaatcttggctggcagaatggaaatccggacatgatatggcacaagcacacaatgcttatgatcgctatattttaaatgaacttgttccactaatccgttatgaatcaaaatgggacggagcaatgattgcgacaggttgtagtatgggggcattccatacaattaactttgctttgcgtcatccggatttatttgatgttgcaattgcattgagcggtgtttacgacgcacgtttctttactcatgaatatcatggtgattctaccgtttattttaactcgccaattgattatttatggaatcaacatgataactggttcttagaacgttatcgccaaaatcattatattgtggctgttgggcaaggtgcttgggaagaacaacatatagcggatacaaaacgtttagaagaagcatttcgcagtaaaggaatagaaggttggtttgattactggggtcatgatgtggatcatgactggccttggtggcgagttcagatgccatttttcctctcaaaattagaggaacaggggattatttaatcaataaaggaaaacataaaaatctatggagatctcaaaaaaccttactacggtattcatgttccttgtattggtcataatttatatgaaattgcttatcaggcaatcagtttagcggttcgagaaataaatgatagaaacaagatcatttctaaaattgtcattagaagtcggctgatagatagtaataaataaaaaactaaggggaattcagacttaaagaacaaaattagtgatcaaagcctagttaaatccttataataaatacaagaagttaactgggtcagagacttttaatgcacattgcagtagtaatgatcttcaaaaatacgaccaaaattaaggctaaacaacgttataaatgaaaaagtgagcataaatctgctcactttttgatgctccaactacaattccttatgaattttagaattgtctttgtttatttaatggagtattacttaataatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtacctgttacgtcagtagtacggaaatagaattgtggacggtaacctttgaagaatggagtatgacgtcctccttcctcttttgacaacacataaacttctgattcaaagtctgtgtgcggtgtaattgaacccggtttcgctaatacttgaccacgttcaatttcttcacgttttgttccacgtaataatgctccaatgttttctcccgcacgaccttcgtctaataatttacggaacatttctacacccgttaccgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcctgggaagtcgtattgagaaagtaattcacgtacttccatctcaactaattccaataattcttcgtcatctaccatgtcgcatttgtttaagaatacgatgatgtacggtacacctacctgacgacctaataagatatgctcacgagtttgtggcattggaccgtctgttgccgctaccactaaaatagctccgtccatttgtgccgcacctgtaatcatattttttacatagtcagcatgtcccggacagtcaacgtgtgcgtagtgacgtgttgctgtatcatattcaacgtgtgaagtgttgatagtgataccacgtgctttctcttctggtgcgttatcaatttggtcaaatgcacgtgctgcaccaccaaagtgtttggataatacagtcgtgatcgctgctgttaaagttgttttaccgtggtcaacgtggccgattgtacccacgtttacgtgcggttttgtacgttcaaatttttctttagacacttttcagtttccttttattgagtccccaaaagtgcggtgcaaatttggggagttttgttgattaaataaaattattttttacgtgcttcaattactgcatccgccacgtttttcggtgcttcagcatattttaacggttccattgaatatgatgcacgaccttgagtttgtgaacgtagatccgttgcataaccaaacatctctgctaatggaacttcagcattgattttcacaacaaattcgtttgcttcttgaccgcttaccatagcacgacgacgacttaagtcaccaattacatcaccaacataatcaggtggagtttcaacttccactttcatgattggctcaagtaacactggatttgctttattaaatgccgctttaaatgctagagaagcagcaagcttaaacgccagttcagatgagtcaacatcatggtatgaaccgaaatgtaaacgaacacctaaatcaactacaggatatccagctaatggaccggatttaagttgttcttggatacctttgtcaacagctggaatatattcaccaggaattaccccacctttaatttcgttaacaaattcatatccaggaccttcaggttctagagggtataaatcaataactacatgaccatattgaccacgaccaccagattgttttgcgtgttttccttcaacatcgtttacacgagtgcggatagtttcacgataagatacttgtggtttaccgatatttgcttcgaccttgaattcacgacgcatacggtcaacgataatatccaagtgtaactcacccatacctgaaataatagtttcacctgactcttcatcagtgtgtacacggaaagacggatcttcttgagcaagacgccctaatgcaagacccattttttcctggtcagcttttgtttttggttcaacagcaacagaaataaccggttccgggaattccatacgctcgaggataattggtgcatccattgcacataaagtatcaccggtacctacatctttcagaccgattgcggctgcaatgtctcctgcacgtacttctttaatttcttcacgtttattcgcatgcatttgcacgatacgaccgaaacgctcacgtttgtcttttacagaattcaacacagttgcacccgattcaacaacaccggaatatacacggaagaaggttaaattaccaacgaatgggtcagtagcgattttaaatgccaaagctgcaaacggttcatcatcactggcatgacgctcaccttctgtttcatccggattaatacctttaatggcttcaatatctgttggtgccggtaaataatcaattacagcatcaagcatcgcttgaacacctttatttttgaatgctgatccacaagttacaaggataatttcagtttttaatgcacgtaaacgtaaaccttttttaatttcttcttcagttaactcatcacctgaaaagaatttatccatcaactcatcagaagattcggcagcggcttcaactaagtttgcacgccatttttcacattcagcaagcatctctgcaggaatatcttcataggtaaaagtcatcccttggtctgcttcattccagttgatcgctttcattttaattagatcaacaacacctttgaaattatcttctgcaccaataggcaattgtagaggaacagcattgccacctaaacgtgttttgatttgctcaacaacacgtaagaaattggcaccggtacggtccattttatttacgaaagcgatacgcggtactttatatttattagcttgacgccatactgtttctgattgaggttgaacaccaccaaccgcacagtaaaccattaccgctccatcaagaacacgcattgaacgttctacctcgatagtaaagtctacgtgtcccggagtatcaattacattaatacgatgttgtggaaattgttgcgacatacccgaccaaaatgccgttgtagccgcagaagtaatagtaataccacgctcttgttcttgttccatccagtccatggttgcagcaccatcatgtacctcaccaattttgtgacttacacctgtatagaacaaaatacgctcagtggtagttgttttacccgcatcaatatgcgcactgataccgatattacggtaaagtgaaataggggttgtacgagccattattatttccttgtttggaataaatttaaaatatgaacaaggctccaccgcatagtaatgtgatgaagcctaaaaaacactttgctactctaccaacggtaatgtgcaaatgctttattagcctcagccatacggtggacatcttcacgttttttcactgccgcacctttgttctcagaagcatctgataactcattagctaaacgcaaagccatagatttatcaccgcgcttacgtgcagcttcaacgatccaacgcatacctaatgcgttacggcgagttggacgaacctcaaccggcacttggtatgtagaaccaccaacacgacgagatttaacctcaactgttggacgtacgttttccaatgcaatttcaaaagcctctaatgcttcttttcctgtacgttgagataacgtttctaatgcaccataaacgatagattcagcgatggattttttaccatctaccattaaaacattaataaatttcgcaagtaattctgagccgaacttcggatcaggaagaatcttgcgaggttcaatacgacgacgacgtggcattgtaatttctccgttttttatcttcaggattatccaaaactctttatgtaagaaatgacatcttacttttactggagtttatggtaattaatttgttaattagcgtttggccttacttaacggagaaccattaagctttaggacgtttaacgccgtatttagaacgactttgtttacgatctttaacgccggcacaatccaatgcaccgcgtactgtgtggtaacgcacacccggtaagtctttcacacgaccaccacggattaacaccacgctgtgttcttgaaggttatgaccttcaccaccgatataagaagttacttcaaaaccgttagttaaacgaatacgacatactttacgtaatgctgagttcggttttttaggtgtagttgtgtacacacgagtacacacgccacgtttctgcggacatgactctaacgcaggaacgttgctttttacaacctttttcacacgcggtttgcgtactagttggttgatagttgccattaataaaactccaatagtttttacaaaaatgtatatttaataatctatctatacaaagatagacgccgaattctaatcacacaaagtgatattgtcaagaattaagcaattctatcctgcaaaaataacgaaagattccatttagattgggtgaagatctatgctttaagtttctcaatagtttttttatcaaagaaataatgtgtaccacaacattcgcattgcatatcaatactaccgccatgttctgttaaaatattttcaatttcatcatcggaaatcaaaagtaatgcagatccagaacgctctaaagaacaaccacaatgaaattccaccgcacttggtggataaatctccacagtttcttcatggtataagcggtacaatagttcttctgcagttagtccaaataattcttcattttttactgttgcagctaatgtcgcaagatgttcaaaatcctcttgtgaaccggtaccatcaggcatgatttgtaataataatccggcagcaacaggttttccctcatattcaccggaacgaatcaataattgtgtttgtagctgttccgaacgaatgaaataatcctctaagcactctgcaatggttggtttatctaatgcaatcactccttgataacgctccccatttgttggggctatagtaattactaatataccattgccgactaactctgataaggttatatcatcatacacatcatcttgtaaacgagccaatgcacggatttgttgactatcactgccgttaactaacaataattttaacggaccgttaccttgaatttgtatggtaatattgcctttgaattttaaagttgctgtcaataaattggtagcgaccatcatttcacctaataaattccgtacaatacgaggatattcatgtgagttaagtgtatcggtgaaagtcttattcaaacgtacccactcacctcgtacggcacgatctttaaataggtaacggtaaagtttgtcattatctgtttgatatatcatatatttttcctgtttattcaaattttcaatatctatcgtctttataaattgaatgctattcctgatacttaaacttcaataaatctctccgctcttttttatttggacggcgatctgggtgtggcatagaaagtacattattcttacgtgcgattgccattttctctcgctgttcaacactcctagtggtttcacgatacaacaattgtgcttccggtgcaccacgacgttgtgcagatagggctagcacttctacttctttttcttcactaccttgacgcaatttgagtattgcaccaatttccaccgttttatttggtttagtacgttggttattataatgcacctttccaccgtcaatcatttcttttgcaatagtacgtgttttataaaagcgtgcagcccatagccatttatcgagccgaatactatcatctttttccttgggtaaatgctgttttgccatatttgtcttttcgttcagttaaaatcaggggtatgatagggggattaaagacatttgtaaaagggaagattatgaatgaattaaaaagtcaggtactgctggaaaaggttttacaaatcgctcatcaagctggagactatcttaatcttttttacaatggagaatttgattttcagatcaacataaaatcggataatacgcctatcacaaacgcagatttatttgtaaaccagtttcttatcgaaaaactgaccgcacttacgccacatatccctgttttatcagaagaaagctgtcaaatttctttttcagatcgacggcggtggcgtacttattggttgattgatccgctggatggtacacaacaatttattaatcgaacagatcaattcgctgtgctaattgcactgattcatcaaaatcggatcatgttaggtattattcatgctcccgtgttaaaacaaacttattatgccctgaaagggcatggtgcttataaacaaacggaacattctctgcaaactttatcagccagaaaatttgacttaaaccatacagtaaaaattgcagtaggttcaaaaaatgcggagcaaaaagtgcggtcaattttgagatcaaattatcaatacgaatttattacttatggttctagcggtttaaaaaccgcactggttgcagaaggaagtgcagattgctatattcgactgggacaaaccggtgaatgggacacagctgcggcggaagccattttatccgaaataggcggaggaatccgtgatacccaattcaacgccctaacttataacaaacgaccgagtttaataaaccctgattttattatggtatcggacatatctgccgattggaaaaaaatctttcaatttaattaatgagaactattggaaatttagctgatttcagaatattattcacttcttttaatatcggacttaaacaaaatatgaacgtaaatgcagaaaataattgtattgttatttttggagcttcgggagatttaactcaccgaaaattaatccccgcactttataatttatacaaaataggacgtttgacagaaaatttctctgtgttaggtgtttcccgaactgacttaagcgatgaagaatttcgtgaaaaaatgcgtaatgcgttgagaaaaacagaagatataacagaagaacatttggaaaaattttgttctcatctttattatcaggcgattgatacctcgaatgcttctgattatggaaaacttgttcctcgtttagatgagctacatgatacatatcagaccggaggcaatactctttattatatgtccacaccgccaagcctttacggtgtgattcctgaatgccttgccacacacggactaaatacggaagaatgcggttggaaacgtcttattgtagaaaaaccttttggttatgacataaaaaccgcaaaagaacttgatgtgcaaattcatcgtttttttgaagaacatcaaatttatcgtattgaccattatttgggtaaagaaactgttcaaaaccttctcgtattacgtttttccaacggcttatttgaaccgctatggaaccgcaactttattgactatgtagaaattacaggtgctgaagaaatcggtgttgaagaacgtggcggatactataatgattctggtgcaatgcgtgatatgttccaaaaccacttattacaagttttagccatggtagcaatggagccccctgctattattaatgctgattctatgcgtgacgaagtagcaaaagtgttacattgcttacacccgctcagcgaagacgatataaaaaacaatcttgttttaggtcaatacacatcttcaactatagatggtgaagtggtgaatggttatttacaagaaaaaggcgttccagcagactccaatacagaaacctacattgctttacgttgcgaaattgataactggcgttgggctggtgtgccattctatgtgcgtagcggtaaacggttaccaactcgtgttacggaaattgtcatacactttaaaacaaccccccatccagtcttcagtcaaaatgcaccggaaaataaattaattatccgaattcagcctgatgaagggatttcaatgcgtttcggcttgaaaaaaccgggtgcaggctttgaagcaaaagaagtgtcaatggatttccgctacgctgatttagcaacaccaagcctactaagtgcctatgatcgtttattattagatgccataaaaggcgatgcgacactttttgcacggacagatgcagtacatgcctgctggaaatttgtacaacccatcttgaattataaaaaagatcaagggcgtgtttacgaatatgaagccggaacctggggaccaaccgaagcggataaattaattgctaaaacggggagagtatggcgtaaacctagtggaatgatgaagaaaaaagtctaaatcaaataaatagtaattaaacgtaataacacttgccataaggaatacgaatgaatacaaaaatttttgatacggctcaacatgcagttgaacaaatcgctcaggaatttgtgcaatatagcaaacaaaatcgtgcggtgcatatttccctttcaggaggttcaacgcctaaattgttatttaaaacccttgctcaagagccgtttaaaagcgaagtgcggtgggaaaatttacatttttggtggggagatgatcgtatggttgaaccgaataatcctgaaagtaactacggtgaagtgaaaaaattactgttcgaccacattaggattccaacagagaatattcatcgtattcgtggcgaagaaaacgttgaacaagaacttgcaagattttcgcaagagctgattgcatgtgtaccgaatcttactttcgactggattattttaggtatgggaacagatggacatactgcgtcactctttccttatcaaaccgattttagtgattcgaatgtagcggtcatcgcaaaacatcctgaaacggggcaaattcgtatttcaaaaaccgcaaaactaattgaacaggcaaaacgcattacttatttagtaaccggtgaagccaaagcggaaattttaaaagaaatacagaccgcacttccagaaaatttgccttatccggcagccaaaattaaagcaaaaaatggcgtaacggagtggtatttggataaagccgccggaaaattattgttatcttgatctattaattgcttaaatcagtggagcttattatgaaaaaatggttttctgtggtattaattgcgatgctttctgcttgttcgattcaaggaatttttgaaaagcaagatgtttcaacacagtttgaaattgttaaacgccgtgtgattgaaaaacacaaagtccctcaaggcatacctgacggtgaattttcaggatctgacagttcatatggacgaacatttaaaacgtttgttaaacatggctatattgataaatactttgatatttaccacccaaatggaaaattacattctcatacggtgttagttgatggtatcgcacaaggttggtcttttggttatactcccgagggcattttacgaacaaaactgttatataaagatggtgcagttatcgaaattattcttttagatgaaaaaggtaatgttattcaacatattaaacaaaaagagggataaattatgtcacaaaaaggcgatatcggcgtgattggactcgccgtaatgggtcaaaatttaattttgaatatgaacgacaacggctttaaagtcgtggcgtataaccgtactacttcaaaagtggatgagtttttagcaggtgcgacgaaaggcacgaacattatcggagcctattcattggaagaacttgccggtaaattggaaaagccacgtaaagtaatgttgatggtacgtgcgggggaagtggtggatcaatttattgaggcattactaccgcacttagaacaaggcgacatcattattgatggcggtaactcaaactatcccgatacaaatcgtcgtgtaaaagccttagctgagaaaggtattcgctttattggctcgggagtttcaggcggtgaagaaggtgctcgccacggaccatctattatgccaggtggcaatgaagaagcgtggcaatatgtcaaaccaattttacaagccatttcagccaaaactgacaaaggtgaaccttgctgtgattgggtaggtaaagaaggttcaggacattttgtgaaaatggtgcataacggtatcgaatatggtgatatgcagttaatttgtgaagcctatcagttcttaaaagatggcttaggtttaagctatgatgaaatgcaacagatctttgctgagtggaagaaaactgagcttgatagctatctaattgatattacaacagatattcttggatataaagatgcggacggcgaaccgttagtcgaaaaaattcttgatactgcagggcaaaaaggaacaggtaaatggacagggatcaacgccttagatttcggaattccattaactttaattacagaatcggtatttgctcgctgcgtatcctctttcaaagatcaacgtgtggcggcatctaaactcttcaacaagactatcggcaaagtggaaggcgataaaaacgtttggattgaagctgtgcgtaaagcattattggcatcaaaaatcatttcttatgctcaaggctttatgctcattcgtgaagcctctgaaaacttcggttggaatatcaattacggagcgaccgcacttttatggcgtgaaggttgtattatccgtagccgtttcttaggtaatattcgtgatgcttatgaagccaatccggacctgattttcttagggtcagatccatactttaaaggcattttagaaaatgcgttaagtgattggcgtaaagtggtagcaaaatctattgaggtgggtatcccaatgccttgtatggcaagtgcggttactttcttagatggttatacttctgagcgtgtgccagcaaacttgttacaagcacaacgtgattactttggtgctcatacctacgaacgcactgacaaacctcgtggcgagtttttccacactaactggacaggacgtggtggcaatactgcatcaacgacttatgatgtataattcaatctcaacacaaaaaagcggtgaactgatcaccgctttttatgtttttaaactaaagaaatagtcaatttatacaagttattcattaattgcatgatttactttgtagttaaggggtaagttgtttacaatgcacaaagattttttattcatcaggattaaaaaatgaaaactgtcaaaaaaagcaaattaattatcaccgcactgagtgcaatgttattactttcggcttgtgccactatagatgagcaaaccggagaacgtaaagatcccttagaaggatttaaccgtgtgatgtgggattttaactataacgttgctgatccttatgtgctaaaaccgattgcaaagggttggaaagaatatgttccacaaccaatcagaaagggattgactaatgtagcgaacaatcttgatgaacctgccagcatggttaatcgtttgttgcaaggtgagtttaaaaaggcaatggtgcattttcatcgcttttggattaattcaatctttggattaggtggactcatcgactgggcaagttatagtgaacctctgcaaattgaaaataaacaccgtttcggtgatacgctaggtacttatggcatggaaacggggtcttatgtaatgttaccgctttacggaccggcaacacctcgtcaagatctcggcaatcttgttgatgtaacttatccgatgttatccttattaggtccttgggggctactcaaatcgagtatacaacgccttgattctcgtgctaatctacttggcaaagaaacattattggaacaatcaaaagatccttatgttacattccgtgaggcttatttacagaatgtagatcatcatactcatgatggacaaataaagagaacgcaagaagaattttctaaagaagacttaaaagacatcgactaaactcaagaaggaatttattatggaaatgacctcaactcaacgcttaatcttagccaatcaatatagattaatgggtttattggatccgaccaatacacaaaaataccaacgtttagaagctattgtgaaaggcggtttcggcttagaactgaaagaattggataaagagttttccgatctttcggaagcggaatgtctcactgtattaaatactttggagatgtataacgcattacaaatttcttacaataatttgccggataagtccgctttgacaccgcatcgcttacaatttgcgggctattgtgcagtgcgggagaaaaaatatcttaattacttacgctttatcacctcagtcgaagggaaatatcaagagtttatgcgttgtgaacatggttgcgactcccaaactccaatgtgggataagtacctcaaaatgcttgacgcctggcgtgcctgtccccatgaatatcatttaagcatggcagaaattcaaaaaatcttaaatgcttaattgagtcaacgttggtaaaaaaaccgcactttataaagagtgcggttttttatgtagtttctatcagtaaatttgctacaaccggcggaatacttttggggtgaggaataagaatttgcttatgccgactcagctcacctttttccaaaataatctgactttttgccaccttgaaagttttacttaaaaatttcaacaagtgagcatttgcctgtccgtcaatgggtggggcagtaatactgattttcagtgcgttatcatatagtccgataaggtgatctttgcttgctttaggttgcaaaaagatcctcaaacgtaaattatctccaattttttccacagcaggcatacatttctaccaattttgacacgatttaagccaacgcccaataatttcctaataaatcatacattacacgattgccataaaataaaataaaggcaagtaacatgggagaaaaatcaaccatccctgttctaggtagtaggcgacgaacaggtttgagcaagggttctcccaattgatgtaataaataacttaaagctccacgattaaaccaacttaaaatcgctcctaaaaataaaatatataaaagcaattcaccaaaagttcttaaggtgtgtaataacgcaataattacgctttgtccaatgggaaaacgtgcacccactatcgcaaaaatcatatgatattttaatacgcctaatacaaagacaacaaagagcggtgcaaaattaacattttttattgttagcaaaactttttgcaaaggcaaaataattggattagtgaatttcaccaaagattgtgaaaaaggactataaaaatcaacacggcaatactgaaaccacatacgtaacataaaaagaaaacttaatacgtcaaaaatagtattcaataaaaactgaattgaatttaattgataaatcattataaccatcctttacgtttaaaataccaataaggtgcaaatgctgctaatgccatcaggcccaatgccagcggatagccgaacttaaaacctaattccggcatattactaaagttcattccataatttgatgctactaacgttggcggtaaaaaaattaccgatacaacggagaagattttaataatacggttttgttcaatattgataaagcccatagcagcttgcatcaaaaagtttactttttgaaataatgactcattatgcggttgtagggactcaatatcacgcaaaatttctcgagcttgttctaactgattggtaggtaaacgtgttttacgcactaaaaaactcaatgcacgttgagtatccattaaacacaatcgtactttagaactggtatcttcttgttcagtgatagttgctaacgcctgatcaaaagcctcaccttgtttaccttctaaaataatacgactcaatttttccaaatcagcgtacacattttcaattacgtcagctaattgttcaattttagtttcaaataagtctaataacacctcataggcattacattcaactaaacgttgattgcgtgaacgcatacggtataaacgaaatgctggcaattcacgatctcttaaagtaaataatcgcccgtcacgaatggtaaaggcaacgctggctaaatcggcataatcattttcatcttcgcaataaaagaaagagtgtaaatgtaagccatcttcatcttcgaaaaaacgtgcagacgcttcaatatcctctaactctaaaaaagtggctaaattttgcccaagtccttcctgtaacaaatcacgctcttctttactcggctcaagtaaatccaaccaaaccgcattatttaactctgtatcagcactttcatcgatacgaaccaaacgggcatcttcgagtgaaaaagcattaatcattttgtcatgctcctctaaagggattatgaacaacgcaatgaacaaaataaaatcaaataagacacgtataaagtgcggtgaaaattatatttgattaaaagatacctgaaaaataggtaatggaacttacctgcgtaatcccgccgataagtgctagaaagacaagacgagatttagaaaaaagataataggtatcgactatgactgtccaaagtgtatgtcctcttgttattaaatcgtgcggaatgttacgcttgaaatagctgttcgtcaaggatttttgcaagaaaaatcccactaaaagcgggatcttataaacaactttcgatttgactactttgtagggtaatcccaccaaatatcgaataattcactgatttcaatttgttgtaaaccgtttttctccaaccagtttttcaccaaagtgcgatgactttcatcacattttcccaatttttccaaacaaactaaaccttcccaatgaagataaccgctaccttcgtaagcaagtccgttttcttgaataacttcacgaataaaacgatcaacgacttcatctacttgctcaatagaggtgttttctgcaaattgccaattcactaaaaagccaagctcttggaattctgctaagtgcatttttttacgttgtctttgattacgtttaatcgccatacttttctcctattgttactattcttgtcaggctgggcaatcatagcatatttatcgcctgtccttaataaaaaaacaaaatccgagcttatattaattatttgttgtgaagtaatgaaaaaaatctttgtatcgctggggaaataaatttgtctttataaaaaatataattaatccctctttcaaaagttaagttttttaatggaatttcaactaacagttgactatgcaattcatgcgttacagccagtcttgaaataaaggaaacccccaaattattgattacacaatgtttaattccttctaagctgttaaattccattatttttagttgtgtaatttgttcatggtcaaaatgttgaaaaataaattttcttgtttcagaaagattaggtttcatgatgagttgttgctggctaagtgcggtgaaatcacatgctgttttttttgctaaaggatttttaggtgaagcaattaaaatgagttcgtcagataaaaatctgtgagtttgataggtttgcggatcaaaataaatttgatccgacataatcaaaaaatcaatttggtgattttctaatttatgaatgagttggggggaaggtaaaatatcaatacttagcttaacgttaggtgatatttttttatattcggcaattattttcgggagcaaataaacacccacaaaatggctggcaccaatagtaatttttccgtagttgggatcatcgtattgatggagatgttctattgaagtttccaatgtagaaagtgtttgctttgcataattttggaaaatcttgccttgttcggttaaataaagtcgattattaattcgctcaaataaaactgtatttaatgactcttcaagttttttaatcttaatacttactgacggttgcgtgcaaaagagtttattcgcagtttctgttacatttaaacattcagaaagtactataaaagctttaagttgacttaaattcatatcaattccataaaaataatttatagcttgtatagaataatacaatttttttatgtttaatcaactctctataatcagattattctatagacaatatatggagtaactcaccatgaatgacacagtaattcaaaatcaagaacaccaatctgcccgaaaagaatggctgaaaaaaatcggtatcccgttagctttaatcgtattacttgtattgatgttcatgccaacacctgatggtttaacggtacaagggcaaaaagcgattgcaattttctgtagtgctttaatcctttgggtatgtggttcaattcctatttatttaacatctttgttagtcattattttattgccattaactcagactgttgcgaaagataaagttgttttcgccactcttggttacgatgtaatttggttgatggtatctgcttttgtgctgacttcagcaatgattaaatcaaatattgctcgacgttttgctttatggatgatcactcattttggacaaacaccacgcaaggctatgtttgttttgatattaattaattttatactagttttcttcgtaccttctacaactgccagagcttcactcatagtaccaatttgtttaattttactggaaatttatcgtgcggtaccgggtgaaagcaattttggtaaattaatgatgttacaaggtgtgcaagctgatgcaattgcaacatcaggtgtaatgacaggaactgccggtaatattattgcggttggatttattaataatcaagctggcggagatattggttatcttgattggcttttggcatctttccccatagcttttgttaccatgataatttctttcttaattggttttaaactgttctcaatgaagaaagaaactcatttttttgaagctttatctcgtcttcaagcagaatataaaaaattaggttctttaactttagatgaaaagaaagctatggcaatctttttgcttacggttctactttgggcaacggaaagttatcaaaaagcatggttcggcttcaaaattagtgtttatatgaccgctgtgatagcagcagttctctgcttaatgccaagaattggattactcacttggtccgaagccaaaattaaatgggatttaatgctgtttgctgccggtgcttatgcagcaggtaacaccttagaatcgactaaaggtgctcaatggattatggacaaagtcgttcatggattaggtttagaaacaatgagccatacggctgtttatgtggtagtaatcttcgtatgtatgtatgtatagccacttgatttttaccagtaaaacggtcaaaacgacaattcttattccatctattattgccttggcacaatctttagggatgaatcctgtaaccttagctttagctgcgtcatttacactgacatatactataacgttgcctccacattccaaagtaaacacaatttattttgccactggttattttagtgtgttggatcaaatgaaatacggtttggttacttgctttatcggtgcctcgatcatttgtttatcaatttttacttggttccaattacttggatataccttataaaaaaacggagaggaatcatgcgattaattttattacgtcacggcgaaacgctatggaatcaagaacatcgcctacagggacaccaaaactcgccgttatctgaaaaaggtattcagcaagcgaaagctattaagcctttgattgagcaattctcacctaaatatgtgatcagttcagatttggggagagcactacaaacagcggaaattattggttataaaaatccaattaaagacagtgagcttagagagttggcaatgggagaatgggaaggttgtagaaaaacggaaataatagctcaacatccggctttatatcaggattggcgtaatggcgattacacaccgaatggggctgagagttggcaagcattttgtcaacgtatttcacaagcactactaaaatgggcaaataaatacgatgacgatattctagctattgttcatagcggtgtaattcgagcagcttgtgaatccttagtatctctttctactaagcatcttttgcctgtaactcaaggaacattgacgatttttgacataagttctgatctacctataaaactggaggcatacaacttagggtgttttatgcctactcgcaatgtagcagattaaaagattatttattttaaaatctagtaaaaaataactgcactttatcggatttgtttatcatttaaagtgcagattatttttgttagggtttattttacccattgcattttatattctgttaatttacttgaaagagaatttatttagcaacagttgctttaattagtttttctgctttggctaaactattttctactgctgaataaggggttttagaatggctaactacttgttcagcagtatttaataacactttcacttcgccttgttccgcttcagtcactaacacctttaatggtaattgtaatgcaagactgggatctttaaccatcaatggtgtgcctgcttttggggtgccgtaaataattaccgttgcaggttgcattgttagccccgcttctttagcagctttttgatgatcgatttttgcgaaaatggtcattcctttttctgtgagtgtatctgtaagcacagttattgtttggtcaaaactgtacttactttcaaaagattgtggttgaagtacatcgctatgtgccattgcgacttggcttgcgaaaagtattgaaaaaagagctgttttcttcataaattacctcgttatgttatgtttttaataaaaaataaatcccaaaccccatgtcctaatttatgtccacgttgttcaaacttggttaaaggtcgaaaatccggacgtgggatatagtcatttgtggcggaagtattgtgtaaacctaccgcacttgttaatacttccaacatatattccgcataattttcccagtccgttgccatatgaacaaagccgtttggtaccagtttttgttgaattttttcaacaaagtgcggttgtacaattcggcgtttatgatgttttgttttatgccaaggatcggggaaaaatagttgtaatccggctaaactattgtctgcaatacagtcttgtaagatctcggttgcatcatggcaaataacacgtagattttttacctgcttttcaactgcataagcgatgcaagcacctactcccggcgtatgtacttcaatgccaagataatttttatcgggattttgtagtgccatttctactaaagatttccccataccaaagccaatctccaaaatcacagggttggtgttgccataaatctgtgtgaaatcaaaagcagttgtttgatactcaagtcctaatgttgcccaattattattcatcatgttacgctgaaattcgcttaaacgtcctgtgcgtaatacaaagctacgaactttgcgtttataacgtccatcttcagtaaattcagctatttcaacggtctttcttttttgatcggcaaacgtaatcttttgttctgtcatttcatttgactacttgttaattttgggggcaaattataaggggtttaatagaaaatataaagtgcggttaaatttatcaattaagataaagccgcactttttatttgattatgttacacttctttttattttgattacctaaattatgcaggctcaatcctctattaacaatccttttgcttatacagtacttaaatggtatcggcaattcgggcgtaaaaacttaccttggcagcaaaataaaactctatatggtgtttggttatccgaggtgatgttgcaacaaactcaagtagcgacagttattccttactttgaacgttttattaaagtttttccaaatattaccgcacttgccaatgcacctttagatgaagtgctacacttatggacaggacttggttattatgcaagagctcgcaatttgcatagggctgcacaaaccataagagatcagtatcaaggtgaatttccaacggattttcagcacgtgtgggctttacccggtattggacgtagtacagctggggcggttttatcttcagtacttaatcagccttatcctattttggacggtaatgtaaagcgagtgctgactcgttattttcaggtgcaaggttggactggtgataaaaaagtagaggataagctttggcaattgagtgcggaggttacccctacagagcaggtcgcagattttaatcaagctatgatggacttaggtgcgatggtttgtactcgtacaaaacctaagtgcttgttgtgtccattagccataaagtgcggtgctaatttaaacaataattgggtagattttccgtctaaaaagccgaagaaatcgttacctgagagaaaaagttattttctgattttggagaatcaaggtaaggttggtttagaacaacgccctatttcaggactttggggcggattatattgttttccgcagtttgataccctgactgaattattggcttatctttctcagcaaggtattcaacaatatcaacaatggacggcatttcgtcatacattcagccattttcatttagatatttatccaatttatgcacaaatacaaactgaggaagtggaatttgatcgcacagattggaaaaaaattgcagaaaataacgtagaatattgttctcctatatcaagtgcggtcaaatattggtatgatcctaccaatccaagccaaattggtttggctgtgccggttaaaaatttattgatcgaatttcaaaaaaggaaataattatggcaagaaatgtgttttgcacttacttaaatcaagaggctgaaggattggattttcagctatatcccggcgagttaggtaaacggatttttgacaatatcagtaaacaggcatgggcggaatggatgaaaaaacaaaccatgttagttaatgagaaaaaattaaatatgatgaattccgaacatcgccagttattagaacaagaaatgacaaattttctttttgaagggaaagatgttcatattgagggctatgtgcctccgacagaaaaataatttaacatgaaaaaatatattgtatttgcgattattccttttctttttgcttgtagtagttctacgctaaatgatgactatgatgaagcttttgcaaaagatactcaaggacttgatattttaaccggacaattttctcataatatcgatcaaatttggggagtaaatgaactcctcgtggcaagcagaaaagactatgtaaaatacacagataatttttacactcgcagtcatatcagctttgatgaaggttctattatgattgaaacattgggtgataaaagtcgtttatatcattcgattattcatactttattaatgggtgcggatgcaaaaggaatcgatttatttacctctggcgatgtgcctatcagttctcgtccattcctcgtcggattagttgttgatcataaaggtaaacaagttaaaaatattgcgacggcaagtaattttgcaaattatcttttacaaaataagttgcaaacacgttacctcactaatgggaatcctgtacagtatgttattattccaatggttgcaaaccatgttgcagtgcgtgcccaacgctatttacctctaattcgaaaagccgccggacgttatgggatagatgaaagtttaattcttggtattatgcaaacggaatcaagtttcaatccttatgcaattagttatgctaacgcaataggtttaatgcaagttgtacctcatactgcagggcgagatgtattccgtttaaaagggttaaacgggcaaccgtcaaaaaaatatctctttaatcccgctaaaaatattgatacaggtgttgcctatttgactttattacgggataaatatttagatggtataacaaatccaacttcaaaacgttttgcaatgatttccgcttacaatagcggtgccggagcagtactacgagtgtttcataatgatcgagatatagcaattaacaaaattaatcgcttatatccggagcaagtatatcgtattcttactactatgcacccctctgagcaagcaagaaattatttactcaaagtagataaagcacaaaaaagttatagggtgattaagaatagcgaatctgatttgccttaataaaccataacaaaagaataattaagttacgcatgcttaaaagctaagatatacttaactgacttttcattaaacttattcatggagaactgttatgactgccctttttaccactgctcaaaactggctcgctcaagaccctgatgcggaaactcgtgcagaattacaaacattactcaaccaagccaaagcaggcgatatgaatgcacagaaagagttacataaccgttttaacggtcggttgcaattcggtaccgctggtttacgcggtcgcttacaagctggttctatgggtatgaaccgtgtactcgtggctcaagcagcgggcggtttggcggaatacctaaaaggctatgatagtgaaccctctatcgtattaggttatgacggtcgtaaaaactctgatgtgttcgtacgagataccgctgaaattatggctggtgcgggcatcaaaaccttccttttgccacgaaaattgccaacacctgtactggcttacgctatcaaacacctcaacactacggcaggcgtgatggtcaccgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacacagtgttagacgatgagatcgtagaggcatatatcgcaaaaaccgcctctattgccaaagagccacaagcaaatattaactacgtttacaccgcaatgcacggagtaggctatgaagtgttgagtaaaaccttagcgaaagcaggcttaccacaaccacatttggtcgaagagcaaattcaacctgatggatcattcccaacggtcaatttcccaaatccagaagagaaaggtgcgttagatttagcaattaaactggcaaaagcaaaaaatgccgagttcatcattgccaacgaccctgacgcagaccgtcttgcagttgcggtacctgattcggaaggcaactggaaacctttgcacggtaacgtgataggctgtttcttaggttggtatctagcgaaacaataccacgcacagggcaaacagggcaaattagcttgctcactagtttctagtcctgctctggcggaaattgcgaaaaaatacggtttccaatccgaagaaactttaaccggtttcaaatatatcggcaaagtgaatgacttattgtttggctttgaagaagctttgggctacttagtcgatccagacaaagtacgtgataaagacgggatttcagctgctattgccttcttagatttagtccgtagcctgaaaaaagagggtaaaacactaacagattacgctaatgactttactgcggaattcggtgcatatgtaagcgggcaaatctctattcgtgtgaacgaattatcagatatcggcaaaatgatgaccgcacttcgtaaagaaccactaacagaattaggcggtttcgttacacaatttattgatcacagtaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaagtacggaaaacaggattgctaatttagcataaacacaaaagcacgttttatacctacctgttattttatcgactccatataaaaatcaccgcacttttatctcaataacgaaacaaaagtgcggtagttttacagcaaaatcagataaaattattcctgtgaagaaatacgtttcatgtctgtcatataaccacgcaattcctgaccgattaattcaatcggatgctgacgaattgcatcatttacatcacgtaacaaaatattatcgatttctgttgctggtgttgactcacctaaatcaccacgttttaacgttggaataatttctttagctaaaattggagctgctacgttagcaaataaataattaccatactcagcggtatcagagatgactacattcatttcatataaacgcttacgagcaattgtattggcaattaatggtaactcgtgtagtgattcataataggcagactcttcataaattcccgtttctaccattgtatcaaaagccaattcaacgccagctttaaccattgctaccattaatacgccatgatcgaaatattcttgttcggaaattttaatattttctcctttcggtgcattttcaaatgctgttttaccggtttgttcacgccattccaataaattagcatcaccgtttgcccagtcttccatcatgacacgggaaaattcaccgctgataatatcatccatatgttttttaaatagaaaatccaatttttctttaatttgctcggaaagggaaaatgcacgtaacttagcgctattggataaccgatccatcattaaggtaataccgccttgttttaaggcttcagtaattgtttcccaaccatattgaattaatttacccgcatatgccggatctttaccatcagcgattaacttgtcataacatactaaagaaccagcctgtaacataccgcataaaattgtttgctctcccattaaatcggattttacttccgcaacaaaagaagattccaaaacaccagcacgatgtccaccagtagccgcagcccatgctttagcaatggctaacccttcacctttcggatcgttttcaggatgaacagcaattaacgtcggcacaccgaatccacgtttaaattcttcccgcacttccgtccccggacacttaggagcgaccattaccacagtgatgtcctgacgaattttttctcccagttcaacaatatttaaaccatgcgaatatcccaaagccgctccttgtttaattaacggcataacatcggcaacaactttagagtgttgtttatctggtgttaaattaatcaccaaatctgccgtaggaattaattgctgataagttcctacaacaaatccgttttcacttgctcgctgaaaagaagcacgcttttcctcaatagcttccggacgaagagcataagcaatatccaaaccggaatctcgcatatttaaaccttgatttaatccttgagcaccacatccgataatgacaatttttttaccttttaagaaattaacctcatcggcaaattcctcacgatccataaagcgacaacgacctaactggtcaagttgttgacgcaaatttaatgtattgaaataattacccatttccaatctccttatgtaatattccgctggttataaccaaattaaaatttacggtaaaagcattatacataaatttgctattgcgtaaattgactttattgaaaacttttatttcgttttctcaaatagatctgtttttgtttgtaatttatttttttaatttaaagtagtatgaaaaaacagtataattaaggggttagttaattttttcttaacttcttaattttaagaataatttcttttttgggggaataatgagaatatttaaatcaataaaacaattctttgttaagccatctgcaaaaatagggttaggtatccttttggtcggcggtgcctttgcaggaattgtaggttggattatctttaatgccgttcttgaccataccagtcaagaagaattttgtataagttgccattctatgcaatatccattagaagaactcaaacaaaccgctcattggtccaatgataaaggggtttccgcaagttgccctgattgtcatttacctcacaatacggtggataaatatattcgtaagattcaagcaacaaaggaaatttttgccgaattaagcggtaaaatttcttcgaaaacaggctttgaaaaacaccgtctagaaatggcagaaagggaatgggcgagaatgtccgctaacggttcggcggaatgtaaagcttgtcacagctatgatcgaatggattttgacaaaatgtcagaaattgcacgtaacgctatgatacctgctgccgaaaaagatcaaagctgtattgattgccataaaggaattgcacatcatcttcctgaaatgtcacattcatcatcaaaaagcaatggtttatcttcaagctctttacaagcaaataaaacctattatacggaaaataatgtcgctctttttgctgatgaaacaatggggcaagaaatcgggcagttagaaactggcgtaccagtacattttgtgaaaacaacaccaaaagcggatttagttgaactggaaatgtggcgaaaagacaagggctttggacgaatttggtataatcaattcggaaaaaatattaccgatgccatactaactaaagaatttatgtcggcggagcctaaatatgatgtattggaaagtattgaagatcctattaccggtctaacttggcaaaaagtaaaactttctgtatggattggtaaaaatcaacttattgaaaatattgataatttatgggctgacgcggaaaaaatttataaaacacaatgcagtacttgtcatagacaacctgatgtaaaacattttgattcaaatacttggattgggctgtttaatggtatggtcggttttactaatattgataaaccaacaggaaaacgtgttttacgctatttgcagatgcattcatctgattttcaaccgcacgataacaatcattaatgaggaataaaactatgcaacaatcacgtcgtcaatttttgaaaaatatgtctgttatggctgcgacttttgcaatgcctaacttcctcgttgctaaaagtgcggtggaaaataaacaagatttatcacaatggaaaattaccggctcccattggggtgcaattcgtgccaaagtcattaatggtcgagtaagtgaaattaaaccttttgagtatgatgaatacccaaccgagatgataaaaggaatcaaagggttaatttatagtgaatctcgcattcgctatccaatgatacgattagattggcttaaaaatagacacaacagcaatacagagcaacgaggagataatcgctttgtacgtgtgacgtgggacgaagcccttgacttattctatgaagagttagaacgaattcaacaaaattacggaccttgggctttgcatacgggtaacgtaggttggcgttcaacaggacaattccacagctgtggtaaccatatgatccgagcaatcggcatgcacggacacagtgtcagtactgctggagattactctaccggtgccggacaaattatcatgccttatgtgttaggctcaacagaggtttattctcaaggaacatcatgggagattttacttaaagagagtcaaaacatcattttttgggcaagcgatccggtaaaaaatttacaggtcggttggaactgtgaaacccatgaagcctataaatatttagcccaactcaaacaaaaagtagcagataattcaattaatgtaatttgtgttgatcctgtgaaaagcaagactcaaaattatctgggatgtaaacatcaatatatcaatccgcaaactgacgtgccttttatgctcgccatagcatatgtgctttatacggaaaatctttatgataagcagttcctcaaaatgtacactgtaggatttgaaaaattcgtaccttatttaacaggcgagtcagaagataaaacagcaaaaacccctgaatgggcagaaaaaatatgtggtatttctgcaaataaaattcgtgaatttgcacatttactggcaggcaaacgaactcaattgatttttggttgggccattcagcgtcaacaacacggtgagcaaccttactggatgggtgccgtcttagccgcaatgctcggacaaatcggtttaccaggtgggggaatcaattatgcctatcattatagttctatcggtatacctgaatcaggagccgccatgccgggctctttccctttgaacttggatgaaggacaaaaaccgaaatacgaaagcacggattataacggttatagtgcgattattcctgtagctagattatctgattccttattaaatccgggtaaaacaatcgattttaatggacaaaaagtggtttatgctccatataaaatggcaatcttcagtggttgtaaccaatggcatcgtcattctgaacgcaataaaatgaagcaagcttttcaaaaactggaaactatagtatcaattaattacagttggacagccacttgtcgtttttcagatattgtattaccagcctgtacgccttttgaacgtaatgatattgatgtttacggttcatatagtaaccgtggagtcattgctatgcaaaaattagtcgatccgctttacgattctcgttcagattttgaaatattcaaagaattatgtcgcagatttggtaaagagaaagaatattgtcgtaacatggatgaaatggaatgggtagaaaaactttacgaagactgtcgaaaagaaaatgaaggtaaatttgctatgccggcctttgaaaaattctggaaaacaggatttgtactttttccggaaggtaagccttgggtaagacatgcagacttccgagaagatcctgaacttcatgcaattggtacaccatcaggttttattgaaatttatagcaacaaaatcgcttcctacggttatgaagattgtaaaggtcatccaatgtggtttgaaaaaacggaacgttctcatggcggaccaaaatcagataaatttaaattctggttgcaatcagttcaccctgatcaacgtttacattcacaactttgtgaatcaaaagaattacgtgaaacttatactattcagggtagagaacctttatttatcaatccaaatgatgcaaaagaactaggcattgctcatggagatcttgtgcgagtttataatgatcgaggtcaagctattgtaggtgcacacctttcagaggactatccaagcggtgtagtgcggttacaagaaggtgcatggtattcaccgttagatgaaaaaatcggctctattgatacttatggcgatccgaatactatgactcttgacataggttcttctagcttagctcaagctgtttctgccaatacatgccttgttaatattgaaaaatataaaggcattgctcctgaacctaatggtttcaaaggtccaatagaaattgcattatgataacgttgaataccgaagaaaaaatctttatttattcatggcttaaaaatatattaagccatgaattaactgaacagcagctacaacaatatcaacaaggggtttttactcccttgtttgattttttgtcagaacaagatttggcgaagcaaataaatactgttcgaaactcactcatgcaattatctaatttgcctttagctcatttagaattagctgcggattttgcccaacttttcttgttgaatggagaaaatagtgctttgccttacgcctccgcttacttatcggaaaaagaactaaatcaacatattgcatttattgaccatttactatttaaataccagctaaagtttgatcacaatctacgtgaacccagcgatcatctcgctgtttatttagaattactgataacccttgaaaagagcggtcaaaaagagaaaagttttaactttattcaacattatttattagcttggcttattccttttaataaaaaagtacaaaaaattaaaacagaaacctcgttctaccaagccataacagaaatattaatcacgctgttaaataaaaatgtaaaactctcatagcatttaacaaaatcatcaacaaattagtgagtgatttttatgctggatataaaaaagctaatcttaaaagattagcttttactttatttaatttgcctttcaatcacaccgccaccgagacatacctcaccttgataaaaaacagctgattgtcccggcgtaacagcaatttgtggctcatcaaaccgcacttcaatacaatcatcatttataggaataacttcacaagcaacatctttttgacgataacgtgttttgactgtacaacgtaaattttgacgaattggcaagcgatcaatccaatatagctgagtagccattaaaccttgtgataacagggcagaattatcatttccttgtgcaactactagtacattgttaattaaatctttgtctaccacataaaaaggatcttcacttaacccttttactccaccaatacctaatcctttacgttgacctaaggtgtaatacattaagccatcatgtttgccgatgactttaccgtcaaccatgcgaatttcacccggttgagcaggtaaaaatctttccagaaaatccttaaatttacgttctccaataaaacaaattcctgtagaatccttcttttccgccgtaatcaaaccgagatctcctgctatagccctaacaatcggtttttcaatttcacctacgggaaatagactttgtgccacttgatctttgctcaaggtataaaggaaataactttgatctttattactatccagaccacgtaataattttgtttgtccatttacatcggatcgacgaacataatgtcctgttgcaatgtaatcagcacctaaatcttctaccgcatattccaagaaagccttaaatttaatttctttattgcataaaatatcaggatttggtgttcttccggctttatattcagctaaaaaatgctcaaatacattatcccaatactcagcagcaaaattaattttatgtagctttattcctaatttatcacacacagcctgtgcatcagctaaatcgttagcggcagtacaataatccgtatcatcatcttcttcccaattcttcataaacaatccttcaacttgataaccttgctgttgaagaataaaagcggacacagaggaatcaacaccaccggacataccgcaaatcactttctttttactgtttttagcaatttcaagtgcggtaagttttggtagttttttttcataaacaatggatttcatatttttatttatttttaataatcaagttaattttttattgaaggtaatttttagataaaaacataaatacgctttcatattgcgaggtgtttacatcaaacatctgtaagaatctgtcagccgcttttctatctgcaatttctttttgaacaaatcgttcaaaatctttcttcaaactgtgggaaaaagattttctcatattaataaatttgactaataatgtatgagaataataaccttgctgaaaaatatcctttaaaatattgtcctgctcgatcattaatttgttaatattatcaaattgttcttcaataattttcttatcttctgtggaactaattttctctgaaattttccatttctcagccaaaatttcatctaacttaataaaattatactttattttttcagcatccttcactggtgcaataagtgtataacttgaaccatcaatctttatttcctttgggttagtcttcttttctacagcgaaagcaatagaaaaaatttgagaaattacaagtatcaaaaaaagtaattttttcacaaaagcttctccagataaaaaatatcaagaatattaacgttatttcaactcataaaactgcggttgttttttcgcaaatttttcttcatattcagtttttgcatcttcatcaccagcagcaagtttagcctgcaagttatcacatggagtatcacaatcacagacttttttcatccctaaagcagatataccaccacaacttccagcaatggacttacgttttatgatataaccaagagacatacctaaaataactaaaacaaaaatagcaaaagtgactaaaaataatttcatagaaactccttattttttctgagttgataatatttcagcaaatttagaggacattttattttcaaacccttgtggagttttgaccgttaaataaataggtaaatcatattgctcagcaatttccagtgctttttccgcacctaaaacaaataaacctgtggataagccgtctgcagtcatagcacttttagataagactgtaattgaggctaaattatgctgaacgggctggcaagttgtaggatctatttcatgggaaaaacgttttccatcttgctcaaaataattgcgataatccccggaagttgccatagccaaatcttgtaaaccgacaacttgtgatacagatcgagttccatcaaaggttggcttttcaatagctatttgccaagctttattttcagcattatgaccatttgctcgaatctcaccgccaatttccactaagtagtcagtaataccttgctcagcaatataatcagcaactttatcgacaccaaaacctttagcaatagaagataaatcaatataaatctgcggcacagatttggtcaaaaagaatttattgtctttttgtgttagtctaactttctcaatacctacccaggcttttcgttcagctatttgctccggtgtgggtgctttttctacccgtttttccggtccaaaaccccataagttcacaataggaccaactgttacatctagagcaccttgagtaatttgatttaactttattgcttcagcaactacaaaagccaaatctgcggaaatttcaataggattatttatctccttgtttttgttgaacacacttaactctgaattaggaatataagtggacattttagcatttacatcttgtaagataccttcaatgccttcgtgcattttttgtatacttaacttagtcttgccattatcaatatatttgatatggtaagttgtacccatggttctaccatttaatgacactaactcagcttctttttggcaagcactaagtaaaaataccaacgcaaatacgtttattaaatttaataataatttcttagtcataaagtgcggttcatcctatttataagtttttactaaaggttcatcagcctttttaatatcaatatgacaatagccattaggattttttaataaataatcctgatggtattcttccgctggatcaaatcgttgtaaaggtaacacctcaacaacaattggtttactgtattttttctgttcttgtgtaagagcggttaaaataatttctctatcctgtggatcggtatagtaaatacctgttctatattgtgttcctttatcattaccttgttgatttaaactagtaggatcaattactcggaaataatattgcaaaatatcctctaaacttaatttattttgctcatagatcactttaaccgtttccgcatgaccagtattattgtataacacatcttggtaacttggattttcagttttaccatttgcataacctgaaatagcatccagcacaccatcaatacgatgaaaatagcactctactccccaaaaacaacctcccgcaagataaatagctttgttgctcatacgtaatttcctttatgcaagtataattagtttaaataaaatacaaagcggtcagcttcaaaaatttatgaaatctgaccgcactttattgatcatttaagatcagccaccaaaatcatctaataagatattttcatcttcaacaccaagatcttttaacatcttaattacagcagcattcatcaccggaggtccacacatataatattcacaatcttccggtgcttcatgatttttcaagtagttttcataaagaacattatgaataaagcctgtgtaaccatcccaatcatcttcaggaagtggatcagaaagagccacatgccatacaaagttatcgttttcggcttgaagcatatcgaaatcttctacatagaacatttcacgtttagaacgagcaccataccaaaatgacattttacgttttgattttaaacgttttaattgatcaaaaatatgtgatctcattggtgccatacccgcacccccaccgataaagaccatctcattatcagtttctttagcaaaaaattcaccaaatggacctgaaatagtaactttatctccttctttcaaagaccaaatgtaagaagacatttgacctggcggtacatcaggattacgtggaggaggtgttgcaatacgaacatttagcattatgatacctttctcttctggatatgaagccatagagtaagcacgaataatatgctcgtccacttttgaagtataacgccataaatcaaatttatcccaatcttcgtggtattcttttggaatatcaaaatctttatagtgaacagtgtgtggttctgcttcaatttggatgtaaccaccagcacggaatggtacttcttcaccttcaggtatttgaagtttaagctctttgataaaagttgccttattgtcattagaaataacagtacattcccattttttcacaccaaaaacttcttctggtaactcaatcttcatactgttcttcacatttacttgacaagaaagacgataaccttctttagcttcacgctttgaaatatgtgaaagttctgtcggcagaatatctcctccaccttcagtaactttcacgatacattgaccacaagaaccaccgcccccacaagcagaggatacaaagatacctttatttgccaatgcacctaataatttaccacctgctggtaagttaatagctttaccaggatcatcattaatttcaatagtaatgtcccctgaatttaccaatttagatttagcaaacaaaataagtacagctaaagctaaaacgataacagtaaacattgcaataccaagagtaatttccatttaagtatcccctattacaactgaacaccggaaaatgacataaacccaagagccattaagccaacagtgatgaaagtaatacctaacccacgaagacctgccggaacatcagcatatttcattttctctgtaataccggcaagagcaactatagctaacatccaaccggtccctgcaccaataccataaacaatagactcggcaaagttatagtcacgctgaaccataaaagataccccaccaaagattgcacagtttaccgtaattaaaggaaggaaaatccctaatgcgttataaagtgcggggaaatatttgtctaaaatcatttcaagaatttgaactaatgcagcaattaccccaatgaaagtgatgaaatttaagaaacttaaatcaacaccatcaattaaagctccatctttaagaatgagagaataaaccaattgatttacaggcacagaaatacctaatacaacagtcaccgcaacacctaaaccaaaagctgttgatactttctttgaaactgcaaggaatgtacacataccaaggaagaaagaaagagccatgttttcgataaatacggattttacgaaaaggctaatataatgttccataaattatttctccacctgttccggtttccatgttctcaggccccaaataatgaaaccgataataaagaatgcacttggtgctaataaaaacaaaccgttggtttgataccacccaccatcttggatagtttggaaaatagtcataccaaataatttacctgaaccaattaattctcgaataaaagcgacagtaactaaaattgctccatagcctaaaccattaccaataccgtcaacaaaactttctattggtgcagatttcattgcaaaagcctccgcacgtcccatcacgatacagtttgtgataatcaaccccacaaaaactgaaagttgttttgataacccataagcatacgcacgtaaaatttgatcaaccaaaattactaacgaagcaataattgccatttggacaattatacgaatactgttcggaatataattacggattaaagaaataaaaaagcttgaaaaagctgtaacaagacttaccgcaattgccataacaactgctgtttcaagtttggttgttaccgccaacgcagaacaaatacctaaaatttgtaatgcaatcggattattatcagtaatcggtgataataataactttttaatatttgcatttgccattagttagcccccttttttagttttgctaaatatggaccaaagccattagcaccaaaccaataatcaaacgtaccttgaactcctttagaagttaatgttgcaccggaaagactatcaattccatgttgtgcatcagacgatgcacctttacctacacgaatagccggttgattttcttcatcaagcagtaatttaccaacaaatttagcttgccattttggattttcaatttcgcctcccaacccaggtgtttcaccatggtcatagaatgtaatacctttaattgtattaccatccggttgaattgaaacaaaaccatacattaccgaccacaaacccgtaccatacacaggtaaaacaatttggtttatctgattgttctcatctttaacaagataaacttccgctaatttagcacgttgacgtaaaccagctttatcatcttgaggggcaatagaaacattttgagcggaatctttcgctgcagattttgcatcaaaaccggtaggacattttacataatcaccagaatttaattccacacaacgagcttcaatattcttagtaaaaatatctttaatttgaccggcttttgtatctttttgcaataatcctgcaacacttaaaatatttttttgcttatcaagttgtttttgttcttcttgtgttggttttaacaataccgcagaaccagcaacaataacagaacaagctaaactcaacagaacaacaatcgaaattgttcctccaacactatctttattaaatttagccattgcgagatctccgacgtttaatatttgcttgaacaacaaggtagtcaaataacggtgcgaataaattagcaaataaaatagccagcatcataccttcaggatatgctggatttgccacacggataattacagccatcacaccaattaatgcaccatataaccatttacctttattagtaaatgcggctgaaacaggatctgttgccataaaaaacatacctaatgcaaaaccgcctaatacaaaatgccaataccattgcattgcaaataatggattagtttcagatccaataatattgaataaagttgaagttgcaatcataccaatcatcacaccagcaatgatccgccaagaagcaattcgagcaaaaacgataattgcagctccaattaataaagcaaaagtagaaacctcacctatagaacctggaatattacctaaaaaagcatccatccaagtaataggctcgcctgttgcaacatgttttaatgcaacttgtccacctgcagcccattgagaaagtgcggtcgcaccagagaagctatccgcagctgtccaaaccaagtctccagaaatttgagctgggtaagcaaaaaataaaaacgctcgacctgctaatgctggattcatgaaattcttaccaacaccgccaaacacttcttttgcaacgacaacaccaaaggttgttgccaatgccgcttgccataatggtaatgtagggggaacaatcaatgctaataaaatagatgtaacaaagaaaccttcattaatttcatgtttacgcaccattgcaaataaaacttcccaaaatccaccgaccaaaaagacagttatgtaaattggtaaaaagaaaattgcacctaatgccattttagctaaaacaccagcatcaatagacactaaaccaagcatgtttgctaatgcaaagtgccaatcattagctacattttgagctaagtttgcagaaaaatcaccaacacttaatgcaagaattgattgtgcaccaacattgtacattccgtaaaacattgcagggaataatgcaagccaaacaagcaccatcattcgttttgagtccaacgcatcacgaacatgtgaagatttacctgttactgtacccggcgtatataaaaatgtcgctgtcgcttcgaacaatgcataccatttttcatatttaccacccggcaaaaaagcaggttccattttctctaaaagatgttttaaacccatttttaaccttccttctcgatcttatctaatgctgcacgtaacatcggaccatattcatttttacccggacaaacgaaagtacataaagccaaatcttcttcatccaattcaagacagcctaaagcctgtgcactatccgtatcacctgatgctaaatcacgtaataataatgtaggtataatatctagaggaacaacacgctcatatgcaccaatcggtaccatagcacgatgaccaccatttactgcggaagtaaaattaaataatttactgctgaaatgtcctagtactgttcgagtaatggaaaatttgttttttcctggcataatccagcctaaaaattctttctcacgaccttcagcaataacagatacttgcaaagcataacgtcccaaatagttatatggaccgattgctgtattaccacttaacactgaaccagaaataactcgattttcacccgcacttaattcattttccgttaaatgtgaaagatttgcacctaactgcgtacgaattaaacgaggatttttaacttgtggtccagctaaagaaaccactcggtcagtataaatttcgcctgtagtaaataatttaccaatagctataacatcttgataattcaaataccaaactgatttagttgcactaacaggatcaataaaatgtatatgtgtaccacttaatcctgctggatgtggtccactaaaatcatgaacagctaagttaggtaaatcaatcgttgggatattgctatcaccagctttacacaaatgtaatttgccttcatgtaaacgacttaaaacggttaatccatcagtaaaatcctgccaatgttcttttaaaacaatttcaggatttgctgataatggatttgtatccattgcattaacaaaaatagaagaaggtactgcatcactcgcaggtactttactgaaaggacgcgtacgaagtgcggtccataaaccagaagattgtaaattttgacgaacttgctctgaagtcaattttttcaattcatcttcattatattgagtaaaggtaatttgttcgttaccttccactttaattaccacagattgtaaaactcgcttagcaccacgattgatcgcagttacagtaccacttgcaggtgcagtaaatacaataccaggattttttttgtcttcaaaaagtacctgaccttttttcactacatcaccttcacgcaccttcatcgaaggtcgcatacccacatactcttcgccaagcaaagcaacttctttaacagcattgccgttatggattacttgttctggttttcctgcaataggaagatccaagccttttttaattgtaatcatattgtttgcactacttttcgttagattaaaatatagttgtaacaaaaaagtaacaaccgcgtcttgagtaatgatttcagccgacgaactactaaaaatcaatttatccgcatcaatcacataaaaataaaactcaaattctgttttttactgtacctagcttaatgatagaaacaataaattaaaaatttactaaaaatcaacgagtcattttaactaaataatgactccgattccactttagacacctttttttatgtttttttatgaaatttttgatctatttttgtaaaaaaatcaattctaaaccaaaatattgctaaagagttactgaccaatacctgaacaattaggcgactttggaaaaactttgcctaatttttcccattcttcaggactatataaatgtaaagctaaagcatgaataccttgttgtaactcactactaaacaatgagtaaactaaacgatgacgagcgacttttgtcaaggatgaaaacctattgctcacaacaactaatttaaaatgagagttagcacctcgacctgagctgtgcatataactttcattttctatctgtaaaaagtgcggtgaaaattcttgtaatagctttttttctaggactttttgtatcgacataaaattatccttatttttactatttgatatttgatatataacactatattttcattaataaaaaacagattttatttttatcttacatcaaaaatagatttttttattactcaactctgtttttttattgcatactctttcattacatcaacaaaaaaccgccttttggcggttttttatttataagattaacgttttctttgtgttaaacgatctgttaattcataagcacgtaattttgccaattctcttgaaagtttagataccaacatttcataactagcatctttggcaccagaaacaatattttgttcagccttacgtttcgcctccaaaatacgttctctatcaagttccttaccacgaatagcaacatcagctaaaacagttacaattgttggttgaacctccaaaaaacctcctgaaatgtaaataacttcctcagtatcatcttcaagagtaatttttataatacccggcttgatagcggtaagtaagggtaaatgtccggctaaaatacccaactcaccttcagaacctgtagcttgaatgcctttaacttcaccattaaaaatatgttgttctgcacttactacgattaatttaaatgtcgccatctttttctccttcaagtttgctgttaatcagtcttgaagtaactacatttttttggctttttctagcacttcttcgattgagccaaccatatagaacgcttgttccggtatatgatcgtattcaccatctaaaatacctttgaaaccacgaatagtatcttttagtgatacatatttaccaggagaaccagtaaatacttctgcaacaaagaacggttgtgacaagaaacgttctattttacgtgctcgtgctaccactagcttatcatcttcggaaagctcatccataccgaggatagcaataatatcctttaattctttatagcgttgcaaaataccctgcacacctcgagctacatcataatgttcctgtcctactactaatggatctaattgacgtgaagtagaatccaaaggatcaacagctggataaatacccaaagaagcgatattacgacttaacaccactgttgaatccaaatgagcaaaggttgttgccggagaagggtctgtcaagtcatccgccggaacataaacagcctgaacggaagtaatagaacccgtttttgttgaagtaatacgctcttgtaaaacacccatttcttctgctaatgtcggttgataacctaccgcagaaggcatacgacctaaaagagcggatacttctgtacctgccaaggtataacgatagatattatctacgaaaaataatacgtcacgaccttcatcacggaatttttccgccatagtcaatcctgttaaagcaacacgtaaacggttacccggcggttcattcatttgaccataaaccagcgatactttatctaatacattagattctgtcatttcatggtagaaatcattaccctctcgagtacgctcacctacacctgcaaatactgaataacctgaatgttcgattgcaatattacggattaattccatcatatttacagttttacctacaccggcaccaccaaataaaccaactttaccacctttagcaaaaggacaaattaggtcaataactttgatacctgtttctaaaagttctgtactatttgattgttcttcatagcttggtgcagcacgatgtatagcccaatattcttccgcaccaatttctcctttttcatcaataggctctcccagaacgttcataatacgtcctagtgtttttgttcccacaggaacagaaattggatttcctgtattttctacttttaaaccacgttttagaccatcagatgaacccaatgcgatacaacgtactacaccgccacccaactgttgttgaacttcaagagttaatcctgattcaacttttaatgcatcataaacttttggtactgcattttgtgggaattcaacatcaattaccgcaccgataatctgtataatttttcctgctgacattaccttatctccattaaattgctgctgcacccgcaacaatttcattcaattcatttgtaatacttgcttgacgagctttgttatacaccaactgcaagtcattaattaaattacctgcattatctgttgctgctttcattgctaccattctagccgcctgctcagaagccaaattttcaacaacagcttgataaacttgagattccaaataacggactaataaactatccaacaaagtttgaggatttggttcgtaaatgtattcccaattatcactatttttgcctaagctatcattatctaattccggtaatggaacgagtttttccattattggtttttgcgacatcgtattgataaacttattataagtaacatagattgcatcaattttaccttctttataagcctcaaacatacgatttgctataccaattaattcttcagctacaggggtatctcccatacctgaatgctgagctttaatttttaaaccaagagattggaaaaaacctataccttttgctccaattaaacctaatgaaacatcaacattttgttctttccagttttttatttcagaaagtgcggtcttaaataaattaacatttaaaccgccacataaacctctatcggttgaaataattaagatgccaacgtttttaacttctcgttcaatcaaaaatggatgttgataatcaatattggcttttgatatatggctaattacaccttgtattgctttagaatacggacgtgaagacgacatacgatcttgcgttttacgcattttcgatgctgcaaccatttccattgctttagtaattttttgcgtactttgcacactggatattttggttcttatctcttttgcaccagccattttatttctccgttaattaactattaccatgcaacatttgctttaaattgatctaaaacggttttcaatgtatttttaatttcatcatcataattaccagttttagtcaactcagccataaaatcagcatagttgtagtttgcatattctaaaagtgcggtttcaaaagtacctatacgatttaattcaacgtcatctaaataaccaaattcaacagcaaataataccaaagcctgttcagcaacacttaacggtgaatactgtttctgtttcaataattcagttactttttgtccatgtgataattgtttacgtgtagcttcatcgagatctgatgcaaattgagcaaaggcagctaattcacgatattgagcaagtgcggtacgaataccaccagccaattttttaactactttggtttgtgccgcaccacctacacgagaaaccgaaatacccggattcactgcgggacgaatacccgaattaaataaattggattccaagaaaatctgaccatccgtaattgaaattacattagttgggacaaatgctgaaacatctcctgcttgagtttcaatgataggaagagcggttaaagaacctgtttttcctttcacttcaccttttgtgaatttttctacatattcttcactcacacgagaagctcgttcaagtaaacgagaatgaagatagaatacatctccaggaaaagcttcccgacccggtggacgacgtaaaagtaatgaaatttgacggtaagcaactgcttgtttagataaatcatcgtaaacaattaacgcatcttcaccacgatcacggaaatattcacccattgcacaacctgagtatggagcaaggtattgtaaagctgctgactcagatgcagaagctacaacaacaatagtattttgtaatgctccatgttcttctaatttacgtactacgttagcaattgttgatgctttttgaccaatagcgacatatatacattttatacctgaatcacgctgattaatgatggcatcaatagccaatgctgttttacctgtttgacggtcaccgataattaattcacgttgaccacgaccaataggaaccattgagtcaacagccttataaccagtttgtacaggttgatcaacagatttacgttcaattacacccggtgcgataacttctaccggtgaaaaaccatcatttttgatttcacctttaccatcaattggctgtccaagggtatttactactctacctaataaacctcgaccgaccggtacttcaagaatacgacctgtacactgaacttccataccttccgctaaatcagagtaaggtcccatcactaccgcacctacagaatcacgttcaaggttaagtgccatggcataacgattacccggtaatgcaatcatttctccttgcatcacatcacttaaaccatgtatacgaataattccgtcacttacagaaacaattgtccctgtattacgtgcttcgtttatcacctcaaactgagctatacgttttttaatcaattcactaatttctgtcgaatttagttgcatattttattcctcttacaatcgcaactcatttgctagacggttgatttgtccacgacaactaccatcaataacaaaatcatttgtacgaataatagctcctgcaattaacgaactatctattctgcaatttaatattactttacgagcaagtcttttttccattgcggtaataattttctgttgctgtacatcatttaactgttgagcagaaacaacttcaacttgtgatagagatttatattcttcaacataagatttaaactcgttaaatacagctggaagtacagctaaacgcttattttcagccatcaacctaactaaattttgcccatattgatcaagttgttcgccacaaattaagataacagtatcagcaagtttaaaagtagaactagtgcttgttaagtaagattgaactttatcatgacgaataagctcagacaaaaactccaacatattagtccatttttctaccgcacttttatctttttcagactgctctactgcaaaatcaaataccgctttcgcataggggcgagctatcgtagttaattccgacatagtctcaaccttcctataaatctgcaactaatttatcaataatgtcattgttcgccgcttcatcaatgttgcgacccacaattttctcagcaccggcaatagcgagagatgcgactttaatacgcaactcttcttgaacacgtttacgttcagattctatttctgcatgtccctgttcaataattttctctcttaatgcctcagcttcaattttgacttcttccaaaatttcattgcgacgtttattcgctagatccactatttcctgagctttaattctagcttgattaatttcttgctcaactaaaacctttgtatcggattgctcttttttagcagcttcagccgaagctagtgcatttgcaatagatctttgacgttcttctatagctttaataatcggtggccatacatatttcatacagaaccacacaaaaatagcaaaagcaatcagctgacctattaatgttgcatttaagttcacaatgccctccctaaaattggatttattcttctaaagaataatatgattatttatccaactttaattagtttaataaaccaatgaatggatttgcaaaaataaatagtaatgcaatacctactgcaatcattgaaatagcatctaaaagaccagctacaataaacatttttgtttgcaagctagctgctaattcaggttgacgagcagatgattctaagaatttaccgcctaaaagactaaaacctatagcagtaccaagtgcagcagctgctaataaaattacagaaccaaaaatagttgcagtaataatgttttccataatattctcctatagatgtagataaaagtttagccaaaagctaagttgttaaaaaatcaatcgaaaatgtttagtaaaaataatttcataaaacagatttaatgatctgatttattataagctatacttagatatactacagtcagcatcataaaaataaatgcctgtaaagtaataactagaatatgaaaaatagcccaaattaaatgcaaaggaatacctaatacttgcggaataatattatctgccatatacataacagcaataaggacaaaaataagctcccctgcgtacatattaccgaataaacggaaagctaatgaaataggcttagccaaaagggtgactgcttccaataaaaagtttacaggaataaatgcccaatgattgaatggatgtaaggtatattcttttacaaaaccgcctaaccctttagacttaatcgtgtaaaaaataattaatgcaaacacacaaacagacatacctaatgtcgcactaatatcggctgtaggaactgctcgtaaataatgaatacctaataactcggcaaattgcggtggaaaatcaacaggaatcaaatcaatagcattcataataaacacccaacagaatattgttaatgccaatgatccaatttgatgacgaacatcacttccgtgaatattatctttaacaacaccatcaacccactcaactagcatttcaactaaacattgaaattttccaggaactcctgatgttgctttactagcaatacgatagaaaaagaaaaggaacaaaactccagatactaaagaaaaaaataaagtatcaagatggacattccaaaaaccttgtccggtagttaagaatgttaaatggtgactaatatagtcagcagtagtatggccagccatagttaatcctttttaaaactaaattttaaggcatttatttaccataaaaggcaaaagattattcaatacaatacttataagataacctacaaaaaaaactttaaaatcaaccttaaatgttttaaaaatgaatacaaccaaaataattgttaagataaacttaatcaattctccactgtaaaacatttttaggttatttttatactttttgttagtaaaaaacattaaatacacaaaaaggcaatatggaataaaaactgaaagtgcaccaaataagaaagataagtacacttcatgatcactcataccgcctatactcagtaaagcaaaagaaaacataaaaataaaaaactcaattaataatgaaattttatatcttttttgagttttttttattacagcagacatcttatcgttctaatttgctacttacaaaaatcttgccagttacaagcctatttttgcgaatttttaacttaaaatcattttataaatgacagtttcgaccatattataaataattcattaaatttattctaatcttttttaacaaaactaaatgacgcttaccaactaattcaggaacattcaattctatgattttatccacagaaaattgagcagataaagccgaaacttcttccatattatattgaccttttaaagcataaaaaaaaccttgatccgttagtaaatgttgacaccattccgtcatatcttttaaagatgcaaaagctctacttaaaaccccatcaaattgatgatcaggtttaaattcttcaactcgacttaaaacaggttcaacattagttaattcaagttcacgaactgcattacgaatgaaactaatacgtttaccgagactatccaataaaaaaaactttttgtcagggttaattatagctaaaggtaatccaggtaatcctgggccagttccaacatcaataaaaatatttccttgtaaataaggacttacaacaatactatccaaaatatgttttaccaacatttccatgggatcacgcacagatgttaggttataagccttattccatttgtttaataataaaaccagctgaactaaccgctctttttgtaaattagtgggtaaaagagcggtattttttaacaaaaaatttagtttttccattaaattcttttgtaaatcagccattattcacctcgtttcagcataccttgtttttttaaattaacgagtaaaatagaaatagctgcaggcgtaatacctgaaattcgactcgcttgaccaatagaaattgggcggtattgttccagcttagcacaaacttcattggataatcccgatatatttttataatcaaaattagcaggaatagccgtattttcatggcgtttttgacgctcaatttcttcttgttgatgttcaatataaccttgatatttaattgcaatttcaacttgttcaacagcttctttgtcttccattgccggtttaaaaggagtaagtgcggtcaaaatttgataatttatttcaggacgacgtaataaatcttccccatttacttcacggacaagtgggctttttaatatttcattagcctcatttaaatattcagaacgaggatgcaaccagattgaacgtaaacgttgacgttccagttcaatattttccattttttgattaaatcttgcccagcgaatatcatcaattaatcctaattctcttgcaattgaagttaaacgaatatcagcattatcttcacgcaacaataagcgatattctgctcttgaagtaaatactctataaggttctttagttcctacagtacaaagatcatcaaccaaaacacctatataggcttgatctctacgaggaaaccaactttctttttcttgaacaaataaacctgcattaataccagctaataaaccctgtgcagcagcttcttcatagcccgttgtaccattaatttgaccagcaaaaaataaaccagaaatagcttttgtttccaaagttggttttaagtctcttggatcaaaataatcatattcaattgcataacctggtttaacaattcttgctttctctaatcctttcattgaattaacaattttcatttgaacatcaaacggcaaacttgttgaaataccatttggataaacttcattacttgttaaaccttccggttctaaataaatttgatgagaattacgatcagaaaaacgtattactttatcttcaatagatgggcaatagcgtggtccaataccttcaataactcctgtatacataggactacgatctaaatttttgcgaatcacatcatgcgtttgatcattggtatgagttatatagcaaggaatttgctccggatgttgttctacagatcccataaaagaaaaaacaggtaatttttcatcgccatattgtttagctagaatatcaaaattaatagtacgagcatcgatcctcggcggcgttcctgtttttaagcgatttactcttaaatttagatccctaagttttttagcaagatttacagatgcaggatcacctgctcgaccaccagcatagttttctaatcctatatggatcttaccggctaaaaatgtacctgcagttaatactactgactttgccctaaattttaatcccatttttgtttcaacacctgcaatactatctttttctaaaataatatcggttacttcttgttgaaaaatatctagattaggttgattttcaagagcaatacgtacaacttggcggtaaagaacacgatctgcttgagctcgtgtagctctcacagcaggacctttgctactatttaaagtgcgaaattggatacctgctttatctgcagcagttgccattaatccgcccatagcatcaatttcttttactaaatgtcccttacctattccaccaatagccggattacaagacatttgtcctaaagtatctatattatgagttaataaaagcgtttttagtttcatacgagctgtcgctaaagcagcttctgttcccgcatgcccaccaccgattacaatgacatcgtaattttctgtataaaacataatagtctaagtgttattaaaggttttagagttcaaaatagcgatctattctacattaaattacaagataaacaaaaagaagaaagaagtaaaagatcatcagttgatcttcttcttaatataaatagaatctttttatatataaaagtattattatgtatattattaggatctttttttttgttaataagtgtttttttattttttaaaataataagttggatcttttttttattgttatgatctagatcgtttacagtaaaaaatctgtggatatttttatattttatccacaaattttttttaataaaaaacttttttatcttaataacaggaaattttttgttttttattaaagttatccacagagtaatgtaaattaattgaataaatttagattaacattttttaaccagttttcagcaaaatgatcaggatcatcaacattaatgacatctatttttaaactttctgtaatttttacagcttttttattcagtaaaatgtcttcaatttgattcacagcatagcaaaaagtatcataatcggagcttcctaaaccaataacagcaaaacgtatttgagaaagatctaagtttttttgtgtaatttcttcaaataggggttttaagttatcaggtagttcaccggaaccatgtgttgaacttactattaaccaatttttatgtttaattacatcatttagtgaagggccatgtaatagattagtcgatatacctttcttatctagtaagaattgaatatgttcggctacatattctgcacctcctaacgtacttcctgttagaatgcaaatttgtttattcatcttaataccttaattttagctaaaaaaataggcttagaattaatctaagccattgattttatgaatttaaatattatcaatacgacccaataatgaacgtaatcgttcttgccagttatgatgttctgtttttaagtgttcattttcgctacgtaattgctcattggtttgacgagatagctcatttttttcttttaattcttcaatttctaattgaagtaattggattgtttcaacagcttgtttaattttttcttctagttggtctaaaatttctaaagacataatggtttccttttaaataaaactaatttgcgtagttattctaactcagttgtctattatttttaaggaaatttatgaaaattttatatgttgtatggcattgtgtaatcaatccattatttgtaatagaaaatataccgctctttatgttttattggagtataacatcagcagtaagttgataaaaattagcctattaagcaaatttttgctataatccgagctaatttttatttataaaaaagagaaattttatgtcagaaaatacaactgaaaattatggtgcaggaagcattaaagttttaaaagggcttgaagcagtacgtacacgacctggaatgtatattggtgatactgatgacggtacaggcttacaccatatggtttttgaagttgtagataatgcaattgatgaagctttagcaggttattgtaaagatattattgttactattcatgcagataactctgtctctgtgcaagatgatggacgtggtattcctgttgatattcatcctgaagaaggtgtttcagcagcacaggttattatgacagtattgcatgctggtggaaaatttgatgataactcctacaaagtttcaggaggattgcatggagtagggatttctgttgtgaatgccttgtcggataaattacaactcactattcgccgtcaaggaaaagtgcatgaacaattttaccatttaggtgatccacaggaacctttatccgttattggtgaaacggaaaaaacaggtacaactgtacgcttttggcctagtcccactatttttactaatattgattttgaatacgaaattttggcaaaacgtttacgtgaactttcatttttaaattcaggtgtatcaataaaattattggataagcggaatgatcgtcaagatcattttcactacgagggcggtattaaggcttttgttgaatacttaaataaaaataagacgccaattcatcaaaaaatattttattttagtgcggaaaaagacgatattggtgtagaagtagctttacagtggaatgatagttatcaagaaaatgtttattgtttcactaataatattccacaacgagacggaggtactcatttagccggttttcgtggtgcattaactaggattttaaacaaatatgtagaagaaaattcgaataaaaaagacaaaaaggatatagcaacttcaggtgatgatgcgagagaagggttggttgctattgtttctgttaaagtaccggatccaaaattttcttcacaaacaaaagataaacttgtgtcttctgaagtaagagctccagtcgagtctgttatgagtgattatttacaagaatttttggaagaaaatccaaatgatgccaaaattattgtaatgaaaattattgaagctgctcgggcaagagaagccgctcgcaaagctcgtgaaatgacacgtagaaaaggtgctttggatatagcaggtcttccaggaaaattagctgattgtcaggaacgtgatcctgctttatctgaattatatcttgtagagggtgattcagcgggaggttctgctaaacaaggacgtaatcgtcaaaatcaggctattttgccattaaaaggaaaaatacttaatgtagaaaaagctcgatttgataaaatgttatcttctcaagaagtgggaactttaataaccgcacttggttgtggtataggcagagatgaatataatcctgataaattacgttatcatagtattattattatgaccgatgcagatgtagatggttctcatattcgtacattgttattgactttcttttatcgtcaattaccggaattaattgaacgtggtcatgtttatattgcacaacctcctttatataaagtgaaaaaaggtaaacaagagcaatacattaaagatgatgaagaaatgcaacagtttgagttaaatttggcattagaaggatcctctctttatgtaaatgaaaatgctccggcaatgaacggaatagcattagaaaaacttatttcggaatataattcagtacaaaagatgattagccgtttatcttttcattatccagaaatattattgaaatcattaatttatcaaaaagcattaactaatgaaatgatgattgatgaaagtgtggttgatttttgggctaaatctttagttaatattttaactgacaaaaaaataagcggtagtagttacaaatatcgtattgtatttaacaatgaacgtcatttatatgaagtagttatcattattcgtacccatggtatagaaaaaaattattttttgaattttgaatttttaaatggaactgaatatagccgtattgttaaattaggtaaccaactacagggtttattagaaaaaggagcttatgtatctcgtggtgaacgtcaacaatcggtttcgtcttttgaacaagctatcgaatggctgacaaaagaatctcgccgaggtctgattattcaacgctataaagggctaggagaaatgaattcagatcagttatttgaaacaactatggatccaaataagcgtacaatgttaaaagtatcgattaaagatgctgttgcagcggatcaattatttaccactttaatgggagatgaagtagaacctcgacgtgaatttattgaaatgaatgcactaagagctaatttagatatttaattttattttttatttatcaattttggaattaatagaggtttttgatgtgtacagttatgcagaaagaagtattaattgaaatgattgctaatactatggctacgatcaatgtaataacagaacctaaagcagaaaataatgaggatcagaattatttgatgaacttaagaaatgatttgtatagtactcatcatgatgacattgattataatctcttatcaatgacagtaaagaatatcaaagataaatatataggtttgcctgttcataaatattatgcgtaggtgataagcataataaataaactcttgatttgtatgaatattatttgtaaataaaaagatccccttaaaaagggggatctttatttttttgttgttctaaaaaattgatgttctttaattaacgcaagaaagggttgagcaaaacgttttaatttaatatcgccgacaccattaatttgtatcatttcttgttctgttattggttggtattgtgccatttcttgtaatgttgcatcgttaaatactatataaggaggaatattttctttgtctgctatttttttacgcaaaaaacgtaatcgagcaaagagatctttatcgtaatttgtgaccgctctttttggtatagtaacggcattagtaatagaagatatccttggtgttgctaattgcaatggttgttcacctcgtaaaataggcaatgaatctaatgtgagttgtaatgttatattaaaatggtcaattacttgttttatcagacctaaatggattaattgtcgaataactgattgccaatattctctactacgatctttaccaatgccgaaaacgcttagtttatcatgttgatattctttaattttttgattttgggaaccacgcagtacagcaataatatacattgccccgaaacgttgccccactcgatagattgctgacattactttttgtgcatcaaccaatccatcatattttttcggaggatctaaacaaatatcacagttattacaaggtttttgttgatattcgccaaagtaatttaatagaactaaacgccgacaaatttggctttcagcaaattcccctatggattgtaatttatgtagttctatttgacgttgcggtatatctggtttttctaaaagtactttttgtaaccaagcgtaatctgcaggttcgtaaaataagacagcttcagctggtaaatcatctcgccccgctcgtcctgtttcctgatagtatgcctcgatacttcgaggtagatcaaaatgagcgacgaaacgcacgttagatttattaattcccattccaaaagcaattgttgcaacaacaatttgtacattatcatgttgaaaagcacgttgaacaaattctcgttgctcattactcataccagcatgataagcttcagctgatattcctttttggcgtagactttctgcaattcgttcaaccttattacgactattacaataaataattccatttttccctttttgttttgcgataaattgagaaagttgctccataggtttaaatttttcaactaaggagtaacgaatatttggacgatcaaaactaccgatataaatatggggattagataatttaagatgaataaggatatcttgtcgggttgcctgatctgctgttgcagttagtgccattattggtgcatcaggaaaacttgctttcaatcctcctaattgagtatattctgggcgaaaatcgtgtccccactgtgaaatacaatgggtttcatcaacggcaataaaactgactttgcaatgagaaataaaatgaaaaaagctggttgttaaggctttttctggagatatataaagcaactttaattttcctgacattgctttattttgaaccaactgttgttgttcaaatgtttgactggaatttaaataatcagcatttataccatttgctaataactgatctacttggtctttcattaatgaaattagaggagaaatcactaaagttaaaccggagaaacaaagagcgggaatttgatagcataaggactttccgccacctgttgccataataactaaactgtcctttttagctaaagttgcttcgataacttccagttgtcctttacggaaggactgatacccaaaaacagaatgtaaaatatcaagtgcggtagatttttccacagaatcttggctaaaatctaccgcacttttttgttgcttccattcttcaactgacattaagaaaaattcacctgttcaccatgagccaaacaagcttgttctaaacattgccaaaacaattttccatcctgagcaatccattgattatttttaaaggcaaaatgaaaacctccagccttgcttgcaagccataattctaataatggttcttgtttatttacaacaatttggctacgatcagcgaaagtaatagtaaaaaccgaaccttgagtatcacaatctacatcacaaccttgttcttctaattgttcttctatttgcaaccaaacttgttcgatattttggtgatattctgctatgttcataaagtttacctatcaataaaaaagaataacaaaagattataaagatttttataagatagtgatagcacaaaggcatttttaatggtaaaaagtgcaagttttttaattaacaaggatataagcaatgaaaaaaataatttcaattttattacttagtgcaatagcttttggtgtgtcaggttgtggtgttaaaggatcattatatttttcagaaacagaacaaaatcaacaaaaagttaattcaaaattaaagtaatcaatatgtaaggataacattatggatttttttctatataaagatggacacttaatggcagaaaatgtctctgtgaaaaaaattgcagagcaatttggcacacctgcttatatttattcacgagcaactttagagcgtcattggcatgcttttgataatgctttaggagatcaccctcatttaatttgttttgccgttaaatccaatcctaatatagccattttaaatattatggcaaggttgggatcaggttttgatattgtgtctcaaggtgaacttgagcgagtattatttgctggaggtgatcctaaaaaagtggttttttctggtgtggcaaaatcagaacaagaaattgcacgtgcattggaagtaggtattcgctgttttaatgtggaaagtgcggctgaattaacaaaaataaatcaggttgcaagaaaaatggggaaaattgcctctatttctttgcgagtaaatcctgatgttgatgctcatactcatccttatatttcgactggtctaaaagaaaataaattcggtgtaagtgttgaacaggctcgagaagtttatcgccaagcaagtcaattggaaaatataaaaattgtaggaatagattgccatattggttcacaactgacagaacttcaaccttttttagatgctacagatcgtttaattgttcttatggagcaattaaaaaaagatggaataacattagaacacgtggatttaggcggtggtttaggggtaacttatagtgatgagaaagcaccacatccaagtgaatatgctacagctttgctggaaaaattaaaaaattatcaaaatttggaaattattttggagccaggtagggcaattaccgcaaatgcaggtattttactcactagagtggaatatataaagagtaatgaaagtcgtcattttgccatcgttgatacaggaatgaatgatatgatcagaccggctttatatcaggcttacatgaatatcattgaagttgaccgcactttgtcgagagaaactaaagtatatgatgtagtcggtccaatttgtgaaacatcggattttctaggaaaacaacgctctcttgcaattgcacaaggagattttatcgtacaacgatcagccggtgcttatggtgcaagtatggcatcaacttataattctcgtccacgagctattgaaataatggttgatggagagcaagttcatttaattaaacgtcgagaggagtttgctgaattgtggcatttagaaaaattactggaaatgtaaatttttctcgtaaatttcaactaactaaaattgagtttttattctgttgttacactgtgtttttggcaacaaaaattagaatataaaataaaacaatataaaaaactgaataattaaaaataaacaatatttaattccaattaaatataattaattaataaaaaaagatatttaatctaaatttttgttgttgactggataaaatattttgttatattgctaaaccttctgtaatgaaataaaaaatataaaaggtctataaaatgaaagatacaacacaaaagcgagaaacattttccggtcgtcgtgcatttatcttagcagcgattggatctgccgttggtttaggaaatatttggcgttttccttatactacttatgaaaatgggggtggtgcatttatcattccttatttaattgcgttattaaccgcaggtattccattacttttcttagattatgctattggacatcgtcatcgtggtggtgcacctttatcttaccgtcgttttaacccgcactttgaaacatttggttggtggcaagtattggttaattttattattggtatttattatgccgttattttgggttgggctgctagctatacctatttttcaataaataacttttggggagataagcctatagagtttttcctgaatgaattcttaaaaatgggtgatattactcaaggtgttagttttgaatttgtaggaatggtgacaggtccattaattgctgtctggctgattgctttaggaatattagcactaggtgtacaaaaaggaattgcaaaatcatcaagtattttaatgcctattcttgtcataatgtttgtaattctcgttgtttcatcattatttttgcccggtgcggaaaaaggattagatgcgttattttcaccagattggtctaaattatccgatcctagtgtatggattgcggcatacggacaaatatttttctcactctcgatttgtttcggtattatgattacctatgcttcttatctgaaaaaagactccgatttaacaggtagtggattagttgtaggttttgcaaatagtagctttgaattgttagcaggcataggcgtttttgctgcacttggttttatggcagcgacagcaggacaggaagttagtgatgtagcaaaaggaggaattggtctagcattttttgctttcccaacaattattaatcaatcaccttttggtgaatttattggtgtattattcttcggttctttaacttttgcagctttaacttcatttatttctgttattgaagtaattatttccgcagtacaagataaactaagaatacgtcgagtaaaagttacttttattgttggtttaccaatgatgttttgttcagtgattttgtttggtactactacaggtttaccaatgcttgatgtgttagataaatttgtaaactattttggtattgtggctgtagcatttgtttcattagttgctattgtttccaacgaaaaattaacttcattgggtaatcacttaaatgaaacatcttcttttaaagttggttttatctggcgtttatgtattgttttaacaacaggtattctagcatttatgttatttagcgaaggtgcaaaagtattctctgaaggttatgaaggttatcctgcttggtttgtaaatatttttggatggggtatgtcgttaagtttattagttgcagcattcttactttcccgtttgaaatggaaagatgaagcattaacacacaaaaaaggagaataaaaatgagtaacagtgctattatgatgatgatcatctctttggtaattatttggggtggtttagttgtatcaatattaagattacctaaagaatgataaatttcaaataaaaataccgcactttgatctgcactctaaaagatagggttaatttcccatctgattaaagtgcagattttttatgatttcatattaatagtagtaggttataaattccttaaccgtcatctattctcgcatgagtgatgacagtaaaattatgctgaaatagcaattttcaaggtgagttcatgggatgggtatcgatccatcattgatcatcatcaaccaagttaaacgaaaacagtatcgcaagtgcagtggagttttttgataacatactctttggttaataactgatttaaccttaataattttttgagtctagttttagttttgtgacaatgaaaaaatcccaaaacttgaaataaaaaatgattttatattgatttagtgatgaatcccctgcttttaaacaggggagggtgattttattgtaaaagtataatctcaacaggttttaatcctgctctctctagacctttattaagtttctttaaagcctgttctttttctgttttagtcaatacattgacattcttgtataaaagtgcggcagtaagattccaaaataaaatgagatttacaggaatacctgagagttttaactctatgtagcaatttgctgctccttttaatttaaaggattttatatctttaatgtgtattttagaaagaagcctttcgtgttttatcgaaagatttgggagatcttttattctttttttccgagcaagttcttgtgcaattttctttgctctagtttgagcaatagatagatagagaatttgacgaaaatgttccttattctgtgtaatttcttttggcaatagataataatttcctatatttagttgagggtttggggttaaagctaaatatgataaagcacctaggctttctaggtatttagctaattccttctctgctcgaatataaaattttccttgctggtataaaccaaacataagacctttcttaaataaaccataaccagaaaaaagatttttcacagttatagttcctatcaattcggtaagttcacttctaatattttcagtgtcttttaatgatttggtcatatataattcaacctcatttattgtgacaaaataaataaaaaccttttgattagaaaaaatctccaatcaagataagttataacacagagagtggattttattttaaataactttctaattttgttaaagtttgtgatagagatcgagaatttataaaaaagtttgctattttctttagattttttagagaaatgataaaatgtgctaccgatggtttacattatcattataattgtttaaaaaccaaacaaaaagattaaaaaaagagaaaagtaatcaaattttgataaaaaatataaaaaaagcttgcattgaaatataaaatgcctataatgcacggcacacaacgacacgctgttgtgagaggttaagcagtgtgtcgttattttttgttctttaacaaactatcagacaaactgtgtgggcacttgtgagactgtattgataagagattaaaagagtaagataagtgcttaaactagagaaattcatagagaaaatgtggatgaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggactaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctaaatgcgggagagataagtgctgaaagcatctaagcacgaaacttgccttaagatgagttctccctaatgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaagacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatgaccctgggtggagacactcagggttttttgttatttgggataaggcggggaagagagaagagggaagaggaaaatgggagaaaaaaagtaataaggtgataacaaggtagtcataaaaagtagggtaatgaagcagagtgaagaggtgcggtaggaaaattgtttttttttctaccgctctttttttaggtgatttatttttagcgatttgcttgacgataaatgatgatcagctactgaacgagaagttacttctagcacaacatttcaaacagaattttctctatagatttctttaatttacaatgggttatcttcatttatagacagatatcattgctaatctacttcagaccattgtaaattttccttattgtcttattaccttgtaggtaaaagtgcgattaaaaaatcatatgtttctttagccaatgaattactgtatgaatgttttgattgtgtttgtaaggtgttacaatataataacgctgattacacggtttttctaagcctttgaaaggggttattaattggtcattaactaaataaggtgtgattaactgttttcgccccattgcgatgccaatatggttaattgcagctgttaatgctaaattcgaacagtcgaataccatagattgtacttggtttaaatcaagactgtaattgaaatatgttaaccaactctcccattcttcaaaatcggaattgtaatgccacgcttgtccgtcatgaagcaataaacagtgttctaaagatttcggattcccatgaagtttatgtttctcggcatattcagggctgcaaaccggaataacgctttctggcatgagttcatagtgatgtaaattttcactatataaatcatcataatagatagctaaatctactttatacctattaaaatcaataacttcattgccagtcaaaatattcagtgtaataaacggatatttttgattaaatcctgctatagcaggaataagccaactttgagctaaggaagggcgagcataaattgtcaatgtgccactgatttcttgattacgtatttcaaaaatttctttatttatgtgaggtactaactatttttacatagataaaaaacaaaaaatttggtcggaaaaattgcggtggggctttgtgtggcaaggctttgccgttttttgtttgggggagttatgcaaaaaataagaatggttaaaaatggtaaataatgggtggtttttgcattattttttgcataactttaagtagtgtttgatcggtttttaaaacgattttaaaaatttaaaatggttttaaactaggcttttaccaatatgtaccacacgcccgataatttgtaggttttgagcctcctcatcagatatagcgattggcgggtattcgtccttgttgtcacttacaagctcaacgccatcccatttcattttaacccgcttaacccatatattctcgccgtgttggattagatagattttatcatcacctttgatttgattacggtttagatccacaagtagttgatcaccattattgatagtcggctccattgaacgcccattagtccaaaataccgcacatttatcagggtttactcgtaggctttgtaatagactatctgcataaggctctttgccatcgggtttggttaccccctcattaaagctgccaaatcccgcagaaacgttgatactgctataactggcaatcattattactacattttccgttaaatcttttactttctctaccgctctttcgatagtttttttaggttgatcgttttcgcctgtgagcaggtagtttggcgtaacgcccaattcattagcgatagtaataatcattgatgcctgtggctcacgttcgttcatttcccagccttgtaaagctgataatgatacatcaactgcctttgccaactctggacgagttaaatttaacctttccctttgctctctaatccgattacctatcaaggaattatttttaaactttgaagccataactttaaaaaatccaatgttaatttttaatgtttttaaaatttaaaattcaattttaaaatcaatgatttacagaaattcattgaaaaaagattaaaaaataactttaaaaattgttttttaaactttacacagttgatttttaggtttattatctcttgcgttaagtcaatggagttaatcaatgagtacattaaacgacactaaaaaaacagcagaagattggcatagagctgatatcatcgctgctttacataaaaaaggttggtcgcttagacaactctctttgcaatatggatacagtcaaggaagcaccctaaaaaatgccctagacagaccatggcttaaaggtgaacgcattattgcagatgcaataggtgttcctgccgaagagatttgggcagagcgtttcgcacaccgtaacaataaaaaatttgctgaaaaggtagcttaaagaggtttttatgagtggaaacaacttaaaaacgcacttttcagcaaaagaattattagcttttagtttatccgctttacctaattctgtgcaaggaattatttaccaagcaaagaaacaaaattgggcaactcaaaaaagagctggtcaaggtggtggcaatgaatacgcccttgtatcaatgcccgaagttatccaaaccgaaatccgtaagaaatttgcggtcgatgtagtgaaagctcaaccgaaacaactcccctcagtgcgtgcagaagtggatttggcgaacctaactacaaaacaacgcgagatagcagatgctcgaatggcgttggtgcagtatgtgctagagcttgagcagtcaatgagtcgaattaaagcggtgacttatttatgtgatcttgcaaaaaatggcaagttgcctgcacaccttgcagagctaattgaagtggcgaatgctaagaaatcagctaagcggacactaagtgtgcgtaccttaaatggttgggtggtggattactgcaaagccaagaatgtagagcaacgtttgaaattgcttgctccacaagtgaaacaggcggttaagcctgaagagatttggtggctaacctcttttttaggtgtttaccgtcagaaaaatgggatttgtttaacggaagcctatcgtcaatttaaagttgaatgggcaagtaattatcaagaaaacccgattttactcgcagaaatgccaagtttgagccaagtgcaacgagcgatggcaaagctaccgctctatgtaaaagagtatggcagacgaacaggctcacattacaaaacgttattaagttatgtgaaacgggattggtcagcattaagagcaaatgatgtgtggattggggacggtcatgctatgaaactgaaagtggctcacccaatacatggcaagccatttacccctgaattaaccatgattattgatggtgcaagtcgaaaaattgtggggtggtcgatggcattagcggaaaacgcttttgcagtagcagatgccctacgccatgccatatcaacccatggtgtcccagctatctactactcagataacggtggtggggaaaagaataaatttttagatgcggaagtaacggggatgttaccccgcttgggtatcaagcacgaaacagggattgcaggtaatccgcaagggcgtgggattatcgaaagattaaacaaaacagtggggttattgattgcacgccagtttgagacttactacggcacaggggcagaccctgaaaccactcgcaaggtgctttacggtgtgaactctttggctaatgcgaaaggcacagtgcttacgccagtgcaaaaaagagcgaaaggcaagctcccaagttggcaacagttactggatatggtgcaacaagtggtcgattggtacaaccaagagcatatccatagcgaaattagatgtataccagctaagaaatatcagcagatgttacacccagaagatgtggtcatgctgacggatattgaattgcgtgatatgagccgacctgagtttatccgcacgcctgagcgaggttggataagttggtgtaacaacaaatattttaataccaaattattagcggtagatgggcaagaagtagtgattggaattgatatccataacgccgaaagcatacaggtgcgaaccaaagacggcagatttgtgtgtgatgcgatttggaatggtaacacaagagaagcctttccagtggcgatgctggaacagcaacgtaaagaacgccatcaacgtcgcagtaagcttaaagagcgacaactggcagagattgatgcggagcttaatcctgttattacgattgagcataaacatgattttaacttgttggcaacagcaagtaagccgaaaaaagagcctgtgccgttattttttacacaggcagaacgagaagattacgaaaaaaagttagcggtaggaggctaaaaaatgaaaaaccaacagcttaaagaatttatgcaagcccaagggttaggacaaaagcaagtagcgaatgcctttggtgtatctgtggcaacagtgagccaatacttgagcggtaaatatcaaggcaactgcgaagaattagatcgcaaagtagatgaaatgctcgaacgccagaaagctaaagtggttgaggctaaatataacgctgaatttgtaccaactttagcggcaaaacgtggaatggaagtgatgcagtttgcccacgttgaaggtgaaattaatgtgatttttggggcagcaggtttaggaaaaacgcaaatgttgaaagagtacgctcgaagaaatagctctgcggtgttaattgaggttgatccgagttgtacgccgaaagtgctactacgcaagattgcagaaacggtcggggcaacggctcgtggaattaataacgagctcttagacagtattgtaagcaaacttaaaggctcggagcggttgttaatggtggatgaagcagagttgctctctactcgctcattagagtttatccgccgcatccatgatttatcaggtattggggggtgttggctggtatgcctcgcttgttggttaatctcaagggtaaaaataacgagttagcacagctctatagccgagtgggttttgcgtgcgatttgggtaatgccctacctgatgatgatttagcgttattggctgaatctgcattaggtacagatgagtttaacgcaccactgattaaagcgtgcaaaggtaatgcacgccgattaagcaaactgatgcgtggcgtggtgcggtcaagcgaaatcaacggcataccaattagtgccgagctggttgagcgttatgcaggtatgttgattagttaggtgacagatgacgtaccgtcaaatttatgcggcgtaccgtggagatgagaacgtggcagacggtacggcggaagaattcggtattatgtagcagttgcacaaaacctaaaatgcaatctcaaccgcagtaaaatttttgatgcccttaatcgttgagggcatttattttggtaaattttagctgattttctcacttgtttgccaatgttattggcttgcgatgtaaattttcccatcaatgggcgtagtcaatccgcttaaccttgtcaaaggtaagctgattcccctgttcattctaattagttttgtaattaagaaaattaggctgccaacaactcttgctcgtacttcattctttcattgagatttttgaagtaggactgggaaatttcttcagggctaaatgcggtcatactgataagctcttgcgtgcgatgattcccttgccagtaacccacccattcccttaatggtaatacccataagcaacgtttgagaatatcactaaataggtcgccattagacttttgacgattatctgacataaacgccacttggttggcataatgtagggcgtatttattatcacatttgtgatgtacaccacgatgtaaatcacggaaacgagcattaaaggattcggcgagattattactcacacctttggcactataacattctttatgattaacactccaacgagcgtagtgaaaatccaaacctttataggctagattttcatcacacataatatcattgccttgttttacgaattgatggtttaatgccaaaattgttttagcattttcagtatagtccattgtaacgatggtgcgatttgaaccccacaatgtttcatcattagaagcacgttgatttaggctgataatgaaacgtttagttggtctcaatttaggatagtttgtctttttatctcgttgtttatgttgattctttttaaaatttgctttgcgtagcttatagttaatcaacgtcccatcttcgtgaatttccccttgcaatggcgttaaatctcgagttttgaatagggcttcacgcagtttatggcaaaggacaaaagccgttttataactaatattaaggtgacggctcattgttattgctgaaatccctttgacttcattcgcaaagagaagaatggcagccaaaatatcaacaaacggtagtttatgaaaagcaaatgctgtattagttgtaatatagaagtggcgttggcaatgtttgcaacaccaacgtttgcgagattgaagaaagtaagcattgtggcgaataccgcaatgcggacaacaaacatcgtgaatattatcaggattaccccaacggtttgctttcaaaagttggaaggcttcatcttcacttaaacggaagatatgtttaagggataatgttttagatttgcttgaaagtaagtaatgagccataagtattccttgtgtgtacaaggcactcaaagctaaacgccagacataaaaaatcgcccacctgaattttcaggtcggctcaaagcgttttgccctgaataccgtactgtcacaagaaatacgtggactttaataaatgagttgcaaaccccaaatagtcccctaataaaagggttctacgcctatatggttcgctatgcttctttgaaagaaactaggctaaatataaataaatggttcattggcaaattgtcattgttcatcaacgatgaacggcattcaaaatagatctacgttgtttttctgtcaaataaaaaagcaacccattgctaggttgcttatgaactgtgattctaaaaaatggatatataacaagttaataaacactaacctgattacctttaatactcacaatatagttatgtgtaatatagtctgcactacctgataatctgttaccaatagaattagccataattctacacttcttcacaccgttgttatcagatatttctttagattcaaaagaagaaaatgcaatataattctgcattcttgttataccttcagcaatacttcctgcaccttccattgctcgaccaaacatatcccagagtggattagagcggtctaacccttgcgtagcgtgccctacaaaaaattgagcgagtttatttgcttgaacattttgagctcggattccttcgttaatgaatctgcggactgtttcttcaacaacataatcatcgcactcaatttccttttgaaaggtaggtactagttgtaaaggcgatatactaggcactaaaacatctatactaaatgcagtagcaatcactggaaaaatatattttccaaacttagaaaaagccattctattctccttgttgtttttcaggattttcagactcttttttctttaaactaggtattttgctaaataattctttaggatatgtgcatactattttcaggtatgtttttagaaattcggctgaattagcatcaagatgagatgttctacgatgtgcaatatagcaaccaacaataaggtagaagtaaatcagttctttcataatgtttccttataactaaaaatcaataccagggaaaaccttgtatagtatgtgtacagtctgatgtagtaactaacggtgtatatcaaccacactagttgtgggtacactcatcaattagtgggtaaaaaatgaatatcaacgagaaaatccgaagaatccgtgaatcaaaagaatggtcgcaagaacagatggctgaaaaactgaatatgtcattaaatggctatgccaagattgagcgtggtgaaacaaagttatacttagacaagttagagcaaattgctcaaatcttagatattgatgttgttgagttaatccaatcaggtgagaaaaatatctgctttcaaattgaatcgccgttaggttcggtgtatcaaggtgtgggggaatcatcgctgttgattgagattgagcgattgaagttgaatctttcgcatgctaacgagaaggaaaatttattgaataagttgcttgagcagaaagataatgagattaatgcattgaaagatttactaaaaatggctatgcccgaataaaacatataaaaacattgtgttctatcgtagagagacaagataacagttgaattctattgggaaaaatatttaaggaataaatgtgagcaaacaaattaaacttagagcatttgaaattgtaaataatgatattagtaaaaatcttcaagtcgttaatttactcaaacaaaaattagatagttcaacttctagtaatgagcgtagaatgcttttaagtgaagatgatcctaagaaggaagaagatttaatttctcacttcaatactgatagaaacaacgttgtttttgcaacaatgttacgtattgcactcggtgataatgttcagcatatcgatgagactctttttcagaaagccaatttttcaattagtgacttactgaatgctaaacttaatacaagtgctatatataaagatcactactattttttgctatctgatcgttttgttgttacaaatctatctagcaggacgacaattactcgcttacaaacatatttaaactggtttctcggcgagttactagaactcaatccgataattgagcttaaagaagaatatgatttgagtaatgtaagatcactggttattcaagatcctgagaataagaatactacaaatattgacagtacggctaaagataacacgaactcaactgtggtatccaaattcaaagacattactcactttgcaatagaacatgtgaaagagctatttgctgatgcagaagatttagatgaaattgattttagtcagttagtttcagccaaactacttattcaaataaagaaaccaactaaaaattctccagaagatgttaaaaaagcattttcagcaatgttaaaacctgtatcagatctagataatatctcatttaaaactcgtaatggcacatcagttacaggaaaccaacttcagaagattaagcaagtagaggtagatactactgacacaggtaaattaaatgaacaaacacttttccaacaaatggagctttttataaaagaactcgaaaatgcaaacaaagattaaatggatagtaattagcttaatcacatttttattatcattcatcttatctccttttcttaatcaagaagataatatgaatcaagctattgtgcctaccatttacacattgtcaggtattatgttttctattggaatgggaatcgcttgtacatttaaccctagccaaattagaaatgaacaagtttttcaacgagtcaaaaaaaatataactaatgtaagaaatacatttttaatgtattttatgctatctacagttacgtttttaattagtcaaattttagctagaaaccatatttccgtaatgaactttactttgatatttgatcctaaaatcttggctttattattttctatagtgagtcttatttattttattgttaatttccttactatccaaaagttgatttttgatatagccgaaagagctatgaatgaaagtaaataagtcaccttctcagcggcttatttatatttcatttttattacttcaatatttaagtaaatcatctaatttaagacgttcttaattgaatgagcgaaatttagttatgagaaaaatttggtaggaaatcaatagaaatatttcttgatatattcataactaaatacctgtgtctggtgtattatctcagaaacaggtatttacaaaaattgtgggagagttctcacactaacactatatgactaggtcgtttttctacattaaaagtattgtatgtttcaatatcatctttattagcctctaaaaaagctttgagagatactgttcccattttcaatctatctacaaaggattggattgctttcctttcctttctgattcagataataatggaacaactatatttttagcatcgctagagcttatttctgccaatccatctgagcctctagctaatgatctcatttgaatagcccatgcttctgtattcaaaaaagcgagaagatcagctaaaaatacttctttgcctttttgtatgcgacacctgtgacaaccattagtgactattatatcggtttgatattcgcctatataacaccattttgccgcacttccccaaattgaaccaaaatacaaatcatgaggctcggaaaaatgtttagccctactaggtaattcccaaccatacatttcttgacttgtaaactcaccataagaaatatcttctaatatgaacatatttataacgatttatcccaattaaactattcttctctccagatgaagaaactttttcaggaagaaaattaactatatctcccaaacgtaggtgtggtcttaattttatattatatataatatttttcactatttgatttaagtaaatctgaaacattatcagttctaagccaactaaaataatttaaagctgacatagaatatcttattctatctaaaactactggaaaatcagtgtttagtacaagctctccatttttatcagatataaaactaccatcaatgggatttcttttatatacaggtttggctattttatttcctgcttcccaacctaagttttcaatagattctataaagaaactataatcttcagaatttaacgatgattttagtggttcttttcgtttttcaagaaacaatatactggcactaacatctgcaccgctgcttttaaagctaaatctaggtaaagcacaaataccagctatcttaacatggcgtaaaagccattctctaaaaattaaaaatttttcggaatgattccctaaataaccattaggcagaattattgctattcgtccttctttttttgcttttctcacgcataattctacaaaaagaagccctgattcctgctgtgatagcaatgaatttttatctaaaataaaagtatttttttctaatatccattgaaaccctaagtcaaaatttttaagaacctcagttcttctttctaaaatcttactaccaaacggaggattgcataatattaaattatattgtttataatcatcatttattgtttctaatgaatcaattttctttatattggttttcccatctccatttaataccatatttaatatagctacttgaactgcattatctgagttatcattaccccaaatataatctgcatgcccatgattaaattttctagcagtttgaaatgctgcaaccaaaaaatctgcgctaccacaagcaggatcaaaaacatgctcgccaaattttaagttcatcacatctataataaagtctgttatcggtgttggtgtaaaaaactgtgcgagatcccacttataaagtgattttgcaaatttcatataaaatgactgtattatatctcttttagaatatgtaattctgatgggagataatacttttaatatatctaataacgcatcattttttattttaaaatcaggagtcaacggttttggtaaatgagaaccgtaaaaatcaataactcgagctaaaagatttttaaatctagggatagaaatgttatcaggtattcctaaagatctaaaatcttgaatttccatagcttcatgaggttgtccttccttgctatgttcatcaaatatttttaccaataaaatctttaagattaattcatatcttgcagaaatatcaaaaccttgttgatgaagagtattttcaatataatcaaatatttcaattaagttattgtttggttttgtttcattaaatgaaataggttttatatttatggaagcaccaaattcaggtaatagatttattaaaccctctctaatttcttttttatcatttgaaaaatcttgccaaaatactcgttgttctaaattatcccagtataatcctaaacatttttggatgtttagcaaaatctaaaaatggtttaacttgagtttcttttacatagtctgattttgaattatctttttttacttcacatagtataatcgcatgttccaaaattgaatcgacatcatttgtaattgtaactttatcaacatctaatacagcgagatcacatctaaagttatttctaccattattaccaaatttcttaactatttgttcgataataatattttgttttggataaccttgcgataataaatagtgtattgcctgtattctataatattcttcagtatatgttagcttatttttagatttttgagatgtttttaatacccctcgtatagggcagatgagttgaacttgctctactgacattatgccaccgcctttttcacagttgcatttgacaaaaattgaatggagattaagctattgcgttgcgttgaacatttttgagatccttattttagtatatcaagtaataattactgtttctctgaaatttctttaaaagaaattgagaaagcatcttttaagttttcaggcatagcacggtaatctgaaattaatttcgtttcttgctctgacattacagttttttgttgttcagactgaaacattccgccttcaccacttacaagccagttcaaattcactccagctttagcaatggcagtcattccttctgcattaggttcacgttcaccgccaacataaccttgtagtgtgcgataagcgaccccgtctgttctgcaaaatctttaattttccagttttttgcttcacaaacttgtcttagtctttctgatatgcacatttgagcgttccattttcaatactagattgaaaaataccgcaaacgagtgcatatttgacattgaatgaggaatattctatcacgtttgagcgtgtatgaaatactctgataacataatttttggggctgtattagattagtaagtatgctagtctataaaaatgaaaataactcattgtaaattaaagaaatctatacagaaaaagctccttgagttttttgtgttagaagtgacagctcgatcagcagctaatattttaggtatcaatccaaattcaagtgccttgttttatcgtaaaattcgtgaagtcatcagctatcatttagcccttgaagccgatgatgtttttgatggacagattgagcttgatgaaagctattttggtggtcatcgtaaaggaaaacgagggcgtggagcaaccggtaaagtggctgtttttggcttgttaaaacgacagggaaaggtatttacggtggtggtagaaaataccaaaaccgaaacgataatgcctgtaatcacaaggaaaatcaagcctgacagttgggtttataccgatacatatcgtagctatgatgctcttgatgtgagccaatttcaccacgaacgcatcaatcattcggagttgtttgcagtgaaagaaaatcacatcaacggtatagaaaacttttggagtcaagccaaacggatactccgaaaatataatggaattgaccgaaaaaactttcctttgttcttgaaggaatgtgaatttcggtttaactttggaacaccaaaagagcagttaaaaacattgcgaaaatggtgtggaatttagggctgatctaatacagcccctaattttttggcaattaaaagtttttacggcaatttaaatttgcaatctaaattattaaactaatcagacatatatcatcagaaataactacaatgacccagcactttcttttaaccagcaaagctcgcacgctttcatctattaagatagctcgcctatctgacgatgaagcatttagcttattatgcgagctacgctggggggagtaaagaagtggtggtttgccctaaatgcggtgtacaacataaagcctactttatctctactcgcaaacaatggcgttgcaaacattgcaggcacacgtttagcattacatcaggaacaatttttgcgaatcataaactgccgattcaaacctacttattcgctattgtattatttgtaaatgtggttaagggaatttcagcctgccaactctctcgtgatttgaatgtacagtacaaaaccgcttttaccttatcacataaaatccgtgaaagcctgattgtacaacgtgagctttttccactttcaggcgagattcatattgatggtacttacgtgcattccgctccacgtccaaagaataagaaagttgaacgtgtagatagacgtttaaaacaaatgctaatccaaacaaacgtgcggtattggttatgcgtgaatgttacgctaaacaggaaaccttatctaatccgcagttagttggagcaaaaaggaccatcacgtttcctattttgtcagaaaacactgaaaccgtgaagaaattagctcactcacatattgagccaaacagccgtattcataccgatgaaaacagtgcttatgatgaattaatcgtagattacaacttacaacgtgtgaaccatcaaaaagaatatcgcagtgatgaagggattaccaataaccttgcagaaagttactttagtcgctttaaacgtatgtactacggacaagttcataaaatgagtaatatttatctcgataattacgcaaacgaaatagcctatcgggaagatactcgcaaactggataatttaacgattttcaacgatatcaccagtaaatgcctttctacaccatcagaaaacgcttggaaaggctattggcaaggtaatcacagacaagtagaaaggctaataatgtaatatggcagacccaatttactatacgcagattaaacaaaaaatcgctcagtttgaacgagaaaaagagcaggtataggctcacctagctctagttgaacgccgtattactttacttcatcaagccttagacgtaatgaacatcggtgaagatgaagttcatcaacacaacaccgaacattttaaatatcgagtttaccataaacgctttaacggcaaattaagccaacttatccaacaggtgatgaaagctgaaccacatcgtttttggcgggcagaagaaataacagaagcggtactcgttgcatataaacaagcccatcgtcctattactaaagattatattgagtctgtccgctccgcttgtgaacgccttgcaagacgagagataatagagagagttgaagttgttcgatacaaagtgattcaatggaaatggaaacaaagatagcggtagaataccactatcagaccgctgacaaacctccagacattgctttggaagtttgatctaataggcacagaaaaaaaagaaatgcctatgcttaaaaatatcgcctctccctgatacgaactcgagatgataagtcttgaacagcgtattcccaaagactatctcgtccgcaaggttgctaaagcgattgattttgaatttatccgtgatgaagtcgctcctctttattgccaagacaactgccgcatggctcttgatactgttcatttgtttaaaatcatgttattgggttatctcttcggcattaaaagtgaacggcagttagtaaaagatattgaagtcagtgcagcttaccgttggttcttgggaatgtgattaacagaaaaagtcattgatgccggtcccctaagtcaaaattatcttcgctgttttaatggcacagattttatcaagatgaagtgatagtaagaaaagctagaaaactcaccgcttgagtggttatccggagtgaagcgcaaggaagatggataaaacgcaaaaaataaacccacttttatcaggttgctggtaaaggtgggtttatcagtggtctgggctgaatatcactattcagttttttatatcatttccgcttactgtgttggttgtaatgtgctattcagtatgcttctagatgtttcaggagcaatttaactgccctttttactagagctaccataatccccgcacaaaagaacactggctctaatttatctcaaaacagttaaatttaagctaaaaaaccataaaaatggctttaattttgttttttttaggctataatttcaaaaaattatgtttctttataaggatttttgtaaatttatggctaatgtgataaatgaaatgtttattgatgtagtaaatgacgctcttactgggaaaaaagatagtcttttgatgagattgaaagtaatagctaaaaagctaaagaaagaactacctgacttagcaaaagaattggaatctttaatttccacttcaagcactaatgctgtcgcaagagggcaatcattaacacctcaattttctcctgttgatgccgataccagacaaaaattactaattgacgtatatccggtaattatggatacagttcctatatggtcagaaaaagtaaatactcagttaaatcgctttatagctgagtgggaaatgaaagaatccttacataaaggcgggctacatccatctacatctctgctcataagtggtccgccaggagtaggtaagacattatctgccaaatggattgctcataaacttgacatacccctcctaactttagatctcgccagtgtaatgagtagttacctaggtaaaaccggcaataatattaaagccgtactcaattatgcttcatcttttccatgtgtattattacttgatgagtttgattcaatagctaaaaagagagacgatacaactgatgtcggtgaattaaaaagattagtaaccgttattctccaagctattgacgaatggcctaagcaatctgtcttgatagcagcaactaatcattcagagcttctagatcctgctgtttggcgacggtttgacagtattattgattttgagcttccaaatcaagagctaattaaaaagtatctgatatctaaagatattagtaataatctgtcaaattatatatcaactaaattacatgatgtttcttatgccataatagaaagagccatcaatcaagctaaaaaaaattctatcatagaaaaaagacctttcagtgcaacattaattaatgaattattaggtgataatgttttactggaaaatgttattgaaacgatgttatcaacaaatatttctcaacgaaaaattgcacaagacttaggaatttcaagatctcaaatacaaaaatttgtgaaagaacaaggattacaacaatgaataataaaaatatgcttcttggttatggagaaacgcttactaggccagtaaaattgaatacaggcggaggacctaaaaataagccgtatacatatgaagaaaacaaacctgttattgtagcgcagctaaataaagtcatttctgaaattaacgacacactaccgcttgcaatgccagagggaaaagcagtagtaaaattcgttcttcatccagcttttttagctaaaagttattttccagttaagctattaaataaattttctcttcaaagtataggcagtaaggctgttagtattaaacctagaaaagatatcaaaaagagagggaagagagaagaatatacaaccgcctgtatttatgtgtccggtaaaaaagaaaattttcaggactttcttgatacattaaatgaagacaacctaaatcaaagcttaaaagatgattttattacgttagaaaatatatctacattaactacctcagataaaataaaaagttttaataatgatgaggttgtagctgttgaaatagctttacatacacccaataccccttcagggattgttgatgcttttgaggtatttgcaaaacaaaatggtgttttcgtagataaaaaaagaagcataagcgtaaaaggattaacattcatacctgctaaagccagtaaaaatatggcattgaaactcgcagaattctcttttctccggaacttaagagaattaccccaattacgggttaatgatcctgtgatattacgttcatctaccaatgactccagtcttagccttccttcagaaggagctataaatcctgatttaaaagtcgcaatattcgatggaggactaggaattaataattttgatccttgggttaaagaatatatatggagtaatggtaataccagtgcgcaattactttctcatgggcaagatgttacatccactgttctttttggtgttgtgaataatgatactaaaaagcttagcgtaccttattgtaatatagatcattatagagtgttagattcggatattaataatactgatatagatttatttgatgttcttatccgtataaaaacagtattagaacaaacaaaatatgattacataaacctaagtttaggtccaagactcccgattgatgacgatgatgttcatgtatggacttcgacccttgaagaaattcttgctaaaagcggagcactttgcaccgtcgctgttggcaatgacggacatttgccagaatcactgaaccgaattcaaccgccttcagatttagttaatggattatctgttggtgcggcaacttctctatcagatgattggaaaagatgtttatatagctgcattggccctggtagaagccccgggtatataaaaccagatggtgttgcttttggaggatacactgaagaaccatttcaaacatatagtccgatgactaacggaattgtaagcactgccggaactagttttgctgccccgttagtattacggcaggcaatagccttaagtacatccttacaatataacatcacgccgttaacagctaaagctcttctcgtacaccatgcagaacctaaagattttccgcgtcatgaaattggatggggacgttttcctaatgatattaatgacattatctattgtagtgatgatgaagtaaaagttatttatcaaggaatactcaaaccatcacaatatatgagggtcttaattccaattccaaacatacctatacgaggaagtgtaacattaagggcaacattctgtttctcaacgtcagtggatccagaacattcccttaattatacaagaagtggacttgaagttattatgcgaaaaagtactgacgatactccaggacttacatttccattttttaatcagaaacgtatttatatggatgaaagtgaacaacgcgatgcccataaatgggaaaatacaataagaagtgaacacaaattcaaggctaacgagctaacaaccccatgttttgacataatttattatggaagagattgtggtatgcctgttgttcatataaatgaactggaagacttaccttacgttttggttgtaacattatctgcagaggaaatgcctgagctatataacctgataagacagagataccaaacactccaaccaattcaggtacagcaacaaattgtattacaacacacttaatattttagtacaataaaatatacatgataaaaatctgaatatcattgttcagctcagaccgctggcaaatctttaaagcaatgtgagcaatctttaggggcagcggtctgatagcggagaataccgctattttcttatgttccaatctcttttaacttccatctgttcttcgggttttgactacgccctacaatagaatgcttttcgataatcccctgactatgtaatcgtcttaatgcatgagaaaatgcaataacaactgactggaaatccgatttatcaggcgtatagccttccaattcaaaagccttaatcacaatctcatttgttgataaccactgatttggaaaatgcttaaaaactttagcaataaattcattcgggcgataagtgtaagctctagatttctcaccacgttgttttgtcgctaatgaaaatggctcactgtttaacgctatcaaggcttgctgtaacgtagcaatatgctgtttagccacctcaatacatctttcgaaataggtaacgtcttgtgttaatttagcgattttctgctgaatagcactcatacttacttgcttttatcatacataaaaatccttgtggttagtaaaactcacaaggattgtagtaaaatttagttaagtagtctttgtgcaactgctacataataccgcatttgttgcgtattatttgcttggtataaaacatcaccaaagtatggaatccttattaaaaaatactgaaaatggatttatggctattggtaatattttactgattataggtgccggaggggcatttaacagtattttaaaggcgagcggattaagtgatggattggctgagattttagcaaattttaatacacatcctattctattggcatggcttgttgctattgttttacatgccgcagtgggttctgcaacggtagcaatgatgggagcaacggcaatcgtgtcgccattacttgttacttaccctgatattagccccgaaattattgtccttgctattggttctggtgcgataggatgcactattgtaacggattctctcttttggttggtcaagcaatattgcggtgcaaccttgaatgacatttttaaatattataccggtgcaactttcatcgcttccgtattagcactcgggtttacatttttattatcaacagtgatttagaggtatcattatgaaaattcaacatttaatgcaagatcctttcattcaaaaattaatgcgttttgaagaagtgatgtggtttaatcctaaaagtgcgggggtaaaaacaggattgtcttacgttgggttggatgtatccgatactcaacaggcggcggaacgtttgcagcgttttgctccttatttttgtcgtgcttttcctgaaactcaaaaaacgaaaggtattttggaatctgaactggtatctattgataagatgaaatcggcattaatcgatcattatcatatgccgatacaaggacgtttattgctcaaaaaagacagtcatttaccaatttcagggtcaattaaagcaagaggcggaatatatgaagtgttggcttacgcagaaaaattggcattagaacaccatttaattaccgaaagtgatgattatagtcaattgtgcgatgaaaagatcaaagattttttcagccgttatagtattgcagtaggatcaacggggaatttggggctttccatcggtattatgggggctgttctcggcttcaaagttagtgtgcatatgtcagcagatgcaagagaatggaaaaagcaaaagttgcgttcatacggtgtgaatgttgtggaatatacacaagattacggtgtagctgtcgctcaaggacggaaggcagctctttccgatccgaactgcttttttattgatgatgagaattcgacaacactttttttaggttattccgttgcaggtcaacgactaaaacaacaatttttggaacaaggtataaaagtagatgaaaatcatccgctctttgtttatcttccttgtggtgttggcggtggacctggcggtgttgcattcggattgaaattggcatttggcgattatgtacactgcatttttgctgaaccgactcattcaccttgtatgctgctcggtgtttatacagggttacatgataaaattgcggtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctgctttggcaggaatgataggtccgttgcatatcaatcactccgattatttaagaagatatcacatcacacaagaacaattggcaaatgcaacacatatagtgtgggcgactggtggtggaatggtacctgatgttgagatgcaaaaatatttgtcactcgggcgattttaaaatattctccccaagttggtttttggggagaagaaagagtgcaagtgcggtagatttttagagagtactggaaataaataataaatttgatgcgtcactattttgtttatttttaagcacattctgatttatttgcaaacatattgcctgttaaacaagcaaacaattaagattttgtaattttttaaaaattattgttgacttaaataagaaaaaaacgtttaatacgcaccactgacttgttgcctcgatagctcagtcggtagagcaggggattgaaaatccccgtgtcggtggttcgattccgcctcgaggcaccattctactcctccttagttcagtcggtagaacggtggactgttaatccatatgtcgctggttcaagtccagcaggaggagccaactctatgttagttatgttatagaacgatgccttattgattattgttttgttaagagggtgtcaaatagaaagtcaagaatttatctcaaaaatagattttcccaatttaaatttaattcattttaatagtatcaatcattcatattaaacttaatgtcttcgggacatggtaattccgcctttcagtgttccctatgctagtatatgcatcaacaagcacaagttatattgcttataatatagaaatagtgcatttgcaatgcttgcagaatcaatgttggtgaggtgtgaaaaaatgggtaatgatgaaggtatatttttttcaaagaaaattaaaaaaattaaacgttaaataatgcttaataataaaacaaaagtgcttttcttttgttaatttggtaaagtatatacatcaaaattcaaattaattagttaaaaattaagaaaaatgatatgtatacatcaaatttcactaatttaatcttaaatgtagacagctataaagcctcgcattggttgcaatatcccaaaggaacagaatatatttcctattatattgaagctcgtcgagaaagttttgatgtagtgatgttcggtttacaggcctttatcaaagaatatttgcttaaacctatttgccaacaagatgttgatgaagcagaaattgtattaaaagcacacggattgcctttttatagagatggttggcaacatctaatacataaacatcaaggttatttacccttaaaaattgaagctgtatcagaaggaacggtcttacctgttggtaacgtggtttgtcaaataaccaatacagatcctgattttttttggttagtcggctatttagaaaccgcacttttaagggcaatctggtatccttccactgttgcaagtctttcctatttttgtaaaaagcaaattagacaagctttaataaagtctgcagatgatctgtccggtttagactttcaattacatgattttggtgcacgaggtgcatcaagccttgaaactgttgcgttggggggattagctcatttagttaatttcaaaggaacagacagtgtttctgccttaattgctgcaaaacgctggtataacattaatgaaatgcctgcattttctattcctgctgccgaacatagcacgatcacttcttggggtaaagatcgggaaataaatgcttaccaaaatatgattgaatgctttggtggagagggaaaactttattccgtagtatcggatagttatgatctttggcatgccctggaacatatttggggcgagaaattaaaagatttggtgatcgaaaaaggcggaagattgattattcgacctgacagtggcaatcctatagagattatttgcaaaaccctagaaattttagcaaataaatttggttatattcttaatcaaaaaggctacaaagttttacctgattgtcttcgcattatccaaggagacggcatcaatgctcaaagtctaccaaaaattcttgatgctgttatgcaaaaaggatttagtgccgagaatgttaatttcggcatggggggaggactgctgcaacaagtcaatcgtgataccatgagttgggcaatgaaagctagtgccatttgtattaatggacagtggcaagagatttataaggatcccattaccagccaaagtaagcgttctaaaaaaggtgttttggctttagtcaaacagggaagtgattggttaacaattaaacaatctgagttaaatggacaaactaatcagttacaaaccgtttttttcaatggaaaactttttatcgaagaaaacttaacggaaatccgcttgcggaccacgtcctttttagtatgaccatattttactcagtgagaaaaagatgatatttgaaaaagtatcatcttttatttttcgcttaacaatgtacttactattttctagccagtggcggtacaaatgtaattcccatatcccaaggttgttcaatccacgtattttgtggaatgtcaataacataatcatcaactaaattagccccggcaggtttggcaaaaacagtaacaaaacgcgcatttgggtagagttcacgaattgctcgagcagtatttcccgtatcaactaaatcatcaactacaataaaaccttcgccaccattttttacctgtgctgcatgcaaaacatttaaattgccttgctgattatggtcataacttgaaatacaaacagtttcaatatgacgaataccaagttcacgagcaataactgcagctggaaataatccaccacgactaacggcaataatacctttccattgtgttgccggaagcaaacgttctgataatttacgtgtatgcatttggaacatgtcccaagttacaacatatttttcgctcataattcaccctaaagtcagttgatagcggagttccgcctgagaaataaaatggcgttagaataacctgaaatctatttttatgctattattttccttatttttcgctaataaaggataaaaaaatatgtcagatcttcaatctctgcaacctaaactactttggcaatggtttgatcaaatttgtgctattccacatccttcttacaaagaagagcagttagcacaattcattattaattgggcaaaaacaaaaggtttttttgcggaacgtgatgaagtcggtaatgtattaattcgtaaaccggcaacagtaggaatggaaaatcgtaaacctgtagtactacaagcacacttagatatggttccacaagctaatgaagggacaaatcataattttgatcaggatcctattttgccatatatcgatggtgattgggttaaggctaaaggcacaacgttaggtgctgataacggtattggtatggcatctgcacttgctgtcttagaaagtaatgatattgcacatccggagttggaagtattgttaaccatgactgaagaaagggggatggagggggcgattgggctacgtccaaattggcttcgttctgagatcttaattaataccgatactgaagaaaatggagaaatttatataggttgtgccggcggtgaaaatgcagatcttgaattacctattgagtatcaagtcaataatttcgaacattgttatcaagttgtgttaaaagggttacgaggcgggcattctggtgtggatattcataccggacgagctaatgcaatcaaagtgttgcttcgttttttagcagaacttcaacaaaaccaaccgcactttgacttcactttagcaaatatccgtggcggttctattcgcaatgctattccaagagaaagtgttgccactttggtctttaatggtgatattaccgtattacaaagtgcggtacaaaaatttgcagatgtaatcaaagccgaattggcactaactgagccaaacttgatatttacacttgaaaaagttgaaaaacctcaacaagtattttccagtcaatgcacgaaaaatattatccattgtttgaatgttttgccaaatggcgtagtacgtaacagtgatgtcattgaaaatgtggtagaaacatcattaagcattggcgtgttaaaaactgaagataattttgttagaagtaccatgttagtgcggtcattaattgaaagtggcaaatcctatgttgcttctttattaaaatctttagcctcattagcacaaggtaatatcaatttatcaggcgattatccgggttgggaaccacaaagtcatagtgatattttggacttaactaagacaatttatgcacaagttttaggtacagatcctgaaatcaaggtaattcatgcgggacttgagtgtgggttattgaaaaaaatctatccaacgatcgatatggtatctatcggaccaacaattagaaatgcacattctccggatgaaaaagtacatattccggctgtggaaacttattggaaagtattaaccggtatacttgctcatattccatcacgttaaaaattgatatacaagacaagtataaagagctgtgtaaatttgcaaagaattgagcaagcacattagataattttctcattcttaaaactaaaaatccttgtagaaaatcgttttttacaaggatttttgtgttgaacaacaatctgtttaattcaacattttctttaactgatataaacactcaagtgcttgcttcggacttaactcattaggatcaagcgtttttagcgtttcaatcaccgcacttgtattctcctcctcttccattaaagttaattccccttgaacttgtgtcaaaacggactgtgattggtaactgttttgctgagaaagtgtttcaagctgttttaatttctgttttgccgatttaattacattttgtgggacaccggctaaagcagcaacagccaaaccatagcttttacttgccgcaccttcctgtaccgagtgcataaaggcaatactgtcgttatgctcaaaagcatcaagatgaacattatggataccttcgattttttctggtaatcccgtcagctcaaaataatgcgtggcaaataacgttaaactgcggattttttgagccaattgttcagcacaagcccaagcaagagaaagtccatcataggttgaagttcctcgcccaatttcatcaataagcactaaactttgctctgtggcttggtgcaaaatatttgccatttcagtcatttcgaccataaacgttgaacgtccggaggcaagatcgtcagaagcaccaatacgtgtaaaaattcgatcaataggtccgattaccgcactttctgcaggtacaaaactaccaatatatgccattaaagtaatcaatgctgtttgtcgcatataagtacttttaccccccatattcggtcctgtaataatcaacaaatgacgcttttgattaagttctacagggttagcaataaaaggttcttttaacacttgctccacaaccggatgacgcccttgcattatttgcaaaccgacttgtgtactaaattgcggttgaacataatttaaggtttctgcccgttccgctaaattggttaaaacatcaagttctgccaaagttaaactggctagttgtaaatcacctaagtgcggtaataattgatcgaaaatttcatcataaagttgtttttctaacgcaagtgacgctccttttgcttttagaactttttcttcataagtttttagctcaggaataatataacgttctacatttttcaatgtttggcgacgtacataatgaagcggtgctttatgtgcttgcccttgactgatttgaatataataaccatgcaccgcattaaaaccgatttttaatgtatcaataccagtatttgcacgctcacgttgctccaaatcctttaagtagcgtgttgctccttcagacaaactccgccattcatcaagctcctcgttgtaaccttcagcaatgacaccgccatcacgaataagtaaggggggattatcaataattgctcgctgcaaaagtgctaattgcacagaaaaatcagcaatttgttgtgaaaatgcaacaaagtgcggtatttttgttaattggtgttgaataaaaggtatttgttccaacgctgttcgtagccgagttaaatctcgaggtcgagcggaacgcagggcaacccgagcaagaatacgctccatatcgccaacttgacgtaaaagaggttgtaattcttcaactaaattttgctgcaacagcatttgaatatgttgttgacgatactgcaatttttcaatattgcgaataggctggtgaatccaacgtttaagtaagcgacttcccatcggggtaacacatttatctaaaattgcagcaagtgtattttcagttccgccagcaagattttgggttagttctaaatttctacgtgttgacgcatcaatttgtacagtatcgctattttgtaacaagctaatactttgaatatgaggaagtgcggtacgttgcgtttcttttgcatattgcaacaaacaacccgcagcacataatcctaaaaccgctttttctacaccaaaaccacgcaaatcttttgtaccgaattggcgattaagtaattgaattgccgtacttaattcaaactcccaaagaggacgacgacgtaatcctttgaattgttcaattaaatgtttatcctctaacgcttccgaatatagtaattcaaccggttgaatacgttgtaactccgcttgtaaactggcggcatcttgtagttcgctaatttgaaaacaccctgaagtcatatctaaaacagctaagccaaattgtgttttttcttgataaatcgtagcgataagattgtcttgcttttccggtaacaatgcttcatcactcactgttcccggtgtaacaatacgtacaacttggcgttcaaccggacctttagctataacaggctcaccaacttgctcacaaattgctacactttccccaagttgtaccaattttgctaaatatccttctattgcatgataaggtacgccagccattggaaccggttgtccagctgattgccctcttttagttagggaaatatctaataattcagcagctttttttgcatcatcataaaaaagctcataaaaatcacccatgcgataaaacaacaaaacatccggattttccgcttttatttttaaatattgtttcatcattggcgtgtgattttcgaatgtgtgcatggctttcattgtgttaataagtaaaaagaatgagtggaattataacaaaagtgcggtctgttttgctggtgttttttgtatctgctttcaagtcaaaagaataaaaatatgtctaaatgatcaagcggttgctcctgccttttatatttttatctcgtttccactaaataaagggtcaatttccggcattacgccacgccataaataaaatgcgtgagcagcttgcccaaccagcataccgaagccatcgctaattttggttaccccctgttttttacacaatgcaataaaaggcgtgtcgctttctttgctgtattgcatatcataaacggcagaggcaagttgtaaaatctgaggattaatatcaatagttttaccttgtaatcctgttgatgtagcattgatgattaaatcaaatgtttgtatcggaatatgtttcagatccaacgcctcaatagtgccaaattgattgaatttatgtgctaagtcttcagctctactaaaagtgcggttggtaattaagatattttgttgagcttgtaataaaggcaataaaactccttttgttgcaccgcctgcacctaaaatcaatattctttggtttggtttgagccaatttaaacgttgtaaatcgctcactaaaccggcaccatccgtattatcagcaaataatgttccatcagctaatttttttaaggtgttacaagactccgcacttaaacaacgcttgctatgttgttgtgccaatttaaatgctcgctctttgaaaggagcggtaatattgcagcctttagcaccttgtgcaaaaaaatcgctcaactgttgttcaaatttttcttcatcacccaatatcgctacataatctaagttttgtcgagtctgcttcgcaaaatatcgatgaagttgaggagatttactttgagcaatgggattcccccaaactgcgtatttatccattttttatccttgtctaactaattgattagtaaataaatcacgaatttcagatggttttgtggctgagccaaccgacatatccaatacaggaaaatccgccccgaattgtaatctgacttcatcgctggttttgcaaggtgcaatcccacttaaattggcactggtagaagttaaagcaaaacctgtttgttcgcaaagtattttgatggcgggatgttggcttactcgaatagctatactattaaaattgccacataagaatttagcaatatctttttttgccggcacaatccatgtaatggggcgaggataagtttgttgtagtttttgccaatgttgagaattgatctgttccttatcaataaaagaaaaaaaataatctaatttgggtgcaactaaaattaaacctttttctcttgggcgttgctttaaaattaataatttttctaccgcactttgactaaaagggttacaacctaaaccgaaaacagcctctgtcggataggcgacgacttcattttgttttaatttttcaataatttgcgtgatattcatattgttgttttgaaaatatgttgacaatttttattgatacacaaccaagtgcggtgattttcgtcttcttttttcaagattgcaccttgcatttggcaattggggcaagggattaaatgaggtttttgtgctaatgtaaatttgcatttcgggtactgattacaagcataaaaattttttccttgccgtccatgtcgagcaacaatttcaccatgttgacattccggacaaacaatctgttgttctgtcgtttcttgttcttcatgcacgacaaaacgacattccggataaccgctacaaccgataaacatgccgtaactaccctgttttagttgtaaaaaacgaccgcacttcggacaattttgagcaagatttttaagtattttactttcattattagggtgtaaaggcttgatataatcgcaagatggatagttagaacaacccaaaaacaatcctttttttccttgtttcatctgcaaaacagcttcacattgaggacaatgttcttgatgtttggtatgttggaaaaggctttttgacatattcttttttcaatcctcgtgagaaaaaacaacaataaacgatcctatcaataatatcaacttacaatcctaatttgaaagccattctagcacagtgtagaatgtgcaacattgtatttaggataagagttttatgaatttacaagatcattttttgattgccatgcctcatttagaggacgagaattttcagcgttccgttgtgtatatttgtgaaaataatgaacaaggctcaatgggattagtgctaactcaagcaacagatttaagcattgctgaattatgtgcaaaaatgaattttatgatggcggatgagcgtgaatattccgataaattagttttattaggtgggcctgtaaatttagagcatggttttattttgcataagaaaacagcccaagaatttcagcatagctataaagttacagatcaaatttatcttacaacttcggcggatataattaatacttttggtaccgcacaatcaccggaaaaatatttggttactctggggtgtgcaagatgggagccgaatcaactggaaaatgaaatagccaataatgattggttggttgtgcctgccgatgaaaatattttatttgatgtgaacagttcggaacgttggtttgccgctaatcaattattaggtattgagcatgtaaatttttcgtatcaacaacaaatggaacatagttaatgtcaattacagttttagcctttgattttggcacaaaaagtatcggttgtgctgtagggcaaagtataacaggtacggcacaagcactcccggcatttaaagcacaagacggtatacctgattggttaaaaattgaaaaatgtttgaaagactggcaacctaatattgttgttgtcgggttacctttaaatatggatggtagcgagcaagatctcactcatctagcgagaaaatttgctaatcgtttgaacggtcgatttggtgtgaaagttgaattacaagatgaacgcctaacaaccaaacaagcccgtgatgaaatattccaacgaggcggttaccgagccttaaagaaagaaaaagtagatagtatttctgcctgtttgattttagaaagttggtttgaaaatggtgcttgtggggaataattacactaaaattaactcaatttccatttcttttatcgattcttgggcatttagtaacagcttgtcatcgcaaataatgctattgaatacatttaattcacaaatagaaaatgtagctgtttttccatatttagaagaatcagataccaaaattttgttgtaactggattgcaatattgcttttttaacaggcagttttttctcatccggtgtagttaagcctcttaaattccaagatgatgtggaaataaatgccagatcaattgaaagctgtttcaataactgtgtagccaattcaccaacagaggagaaattagatttattaattgatcctcctgtatgaattaattcacattgtccatgtttcatcaagaaattagctatcacaaaatcatttgtaattaccaacagatcttctcgttgagcaatattatgtgcgatttctaatgttgttgttccggcatctaagtagatagttgtatttaccggtattagctcagccgctcgactaccaattttttctttttgtagcgtggaaagcaaagatttgtcattgtgtgtcggttcaataaataaatgttctaataatttcacaccgccggaaactgaaacaacaataccttcttgctctaatttttgaatatctcgacgaacagtcatatgagatacacctaataattttactaattcattgatactaataatctcttgcttactaatcagcttaagaagttttttttgtctttctgccggtatcattttttactcctgattttttacataattatatcactttttccatttaggctaatatctataaaattaacattatttaacaaataatgttaaataatgtgatcgtgatctcattttttttgtaaaaaaaagtgcaaaatacaccatcaaataactttaaaggagtgatcagtatgaaccaaaaactattttctgtcgctgttattggtttaggtgcaatggggatgggagctgcaaaatcatgcattcaagcaggattagatacctatggcgttgatttaaatttacaagccttagagattttaaaaacagctggagcaaaacaagtgagtacaagtgcgataggttttgcaaaagatttagatgcagttttgctattagtcgtcaatgcaaatcaagtaaataatattttatttggggaacaaggattggcacagcatttaaaacctaaaactgcggtaatgatttcatccactatttctgcacaagatgccaaagaaatttcacaaaaattaacaaaacttgatttgataatgttagatgcacctgtatcaggtggagctgcaaaagccgctcaaggtgaaatgacggtaatggcatccggatctacagaagcttttgagaaattaaaaccggttttagacgcagtttcaggtaaagtgtataacatcggagaagagattggtttgggtgcaaccgtaaaaattattcatcaattactggcgggagtgcatattgctgcaggggcggaagcgatggcattagccgcaaaagcaggtattccacttgatttgatgtatgatgtagtaactaatgcagcgggcaattcatggatgtttgaaaaccgaatgaaacatgtggtagatggcgactatacgcctctctccatggtcgatatttttgtaaaagatctcggtttagtgaatgacacggcaaaatctttacattttccacttcatttagctagcacggcttattcaatgtttactgaggctagtaatgcaggctacggtaaagaagacgatagtgcggtaatcaaaattttcagtggtcttgatctgccgaaaaaaggaggacactaagatgttaggtgtcatagcagatgattttaccggtgcaagcgatattgcgagttttttagtcgaaaatggcttaaaaacagtgcagatgaacggtataccaaaaaccgcacttcacagcaaagttgatgcaattgtaattagcttgaaatcacgttccaatcctgttgaggaagctatccaacaatcgttacaagccttagattggctaaaacaaaatggctgtacccaattctatttcaaatattgctcaactttcgatagtactgaaaaaggcaatatcggaccggtaacggatgcgttaatggctgcattagaaactgattttactgtcattacccccgcacttcctgttaatgggagaactatctttaatggttatttgtttgtaggtgatgtattgctgaatgaatccggtatgcgtaatcatccgattacaccgatgaaagaggctaatttagttcgcttaatggacgcacagtctcaaggtaaaactgggttattgacttatgcagatgttattcaaggtgctgagcgtgtgaaagtacgttttacagaattaaaacaacagggctataaatatgcagtagtggatgcggtagataattcacagcttgcggtacttgctgaagccgtggcggattttaaattggttaccggcggctcaggtttgggggcttacatagcagcgtatcgctcaggcggtcagaaaggaacgaatgcttttgtaccgaataaaggcaaaacggttgtactttcaggatcttgttctgtgatgacaaacagccaagtcaatgcgtataaagcccaagcaccaagttatttcttgcaagccgagcaagccattaacaatccaaattatgtggaagaactttatgcgtgggttgttgaaaatctaaacggcaactttgcaccgatggtttatgccactgtaccgcctgaaaaattgaaagaaatccaacaccagtttggtgggaataaagcaagccatgcgattgaaactacatttgcaaaacttgcaaaaaaattgaaagttgcaggggtaactaacttcatcactgcaggcggtgaaacatcgagcattgtagtccagcaacttgctttctctgggtttcacatcggcaagcaaattgcacccggtgtgccatggctacaagcagtcgaagagccgatttttcttgccttaaaatctggtaacttcggtaaagagaatttctttagttttgcacaaggaatgtgtgtatgacagaacttgaacaaaaacaacaaatggttgctttagctcgttcattatttgagcggggatatacagtaggtggtgcaggcaatctatccgtgcgtttagataaaaaccgtattttagttacgccaacaggttcttcactcggacgtttagaagcagatcgactttctgtgttagatatgcaaggaaatgtgctttctggtgataaaccgtccaaagaatcggttttccacttagcgatgtatcagaaaaatccgagttgccaagcgattgtacatctacattctacttatttaaccgcactttcttgtttggaagatttagatacggaaaatgcaatacgagccttcaccccttactacgtgatgcgtatcggcaaattacctgtaattccttactatcgcccgggcaacttcaatattgccaaagaattaggcgagagagctttagacggcaaggcttttctgcttgcgaatcacggagtggtagttacaggagaaagcctaatagatgccgtagataatactgaagaattggaagaaaccgccaaactctattttattttacaaggtcaaaaagtgcggtatttaaccgatgatgaagtcaatgacctgaaacacagaggaaaataaacatgcccaaatttgctgcaaatttaaccatgatgtttaacgaagtcccttttttataccgttttgaagcagctgctactgccggttttaaatatgtggaatacctttggccctatgattatccagcagatatgctaaaggaaaaattagataagtatggtttacaacaagttctatttaatacttcagcaggcaatgtagacgccggcgaatggggtgtctctgcgattccggggcgtgaagcggatagtcaccgtgacatcgatcttgctcttgaatatgctcttgccttaggttgttcacacgttcatgtgatggcggcagttgtaccgcaaggcgaagatcgagaagcctataaacagactttcatcaaaaatgtgcaatatgcggcagataaatttaaaccgcacggtattaaagtcttgttagaagcactcagcccggaagtcaaacctaactacctgctgaaaagtcaattcgacacgctagaaattgttgaatccgtcaaccgagataacgtctttgtacagttggattatttccacgcacaaaatgtagatggcaacttgtctcgcttaaccgacaaactcaacggcaaatttgcccatatccaaattgcctccgtgccgaatcgccatgagcctgatgaaggtgaaataaattaccaatatctctttgataaattggatcaaattggctatcaaggttttattggctgtgaatataaaccacgctctgacaccttagcaggtttagattggtttaaaccttatcaacaaaaataaaataggtgctctttatgaattatcagttactttcttatcctctagatgtaaaagatcctggttttccaaatgaacccactctaacttatgatatttgtacaagtactgcacagggagatgtgtataacagtgctatgattcacttgtttaatcatttcgggacacattttgatgcacctaagcattttaatccacatggtttatctattactgaattacctttaatgtatttcatttatgaaaaacccctgttaattgatttgcctaaacctgtcggttcgctaatcgaacctgaggatttatccccttttttaactcatataaaacaggctgattgtttattaattcgtactggcttagaacacttaagatctgaaaatccacaacaatatgctgaaaatggtgttgccgtaagcattcaggctgcaaaatttttgattgattatgccagtaatttaaaagctattggatttgattttatttctcttgcttcaccagcgaatcctgatcatggcatcgaagctcatcaagtaatgttaggaatgtataaagaaaaatttatttgcattattgaagatatgaaattatcgaagcttaataaaaaaacattaaaacgtgttttagctatgcctttacttgttaaaggaattgatagtgcacaagttactgtgttagcagaaggattttagtatgaactcaatgaaaaattatttttggggatgtgtatttttattatttactttcctaagtgcttatcttgcttctttatatgatcgtgattttggacgaattgaagtcagttcagtaagttttatgacagaagaaatgcaacctatggtagctaaactttatcgtcctgtttccgcaaccgcagaaacaccaaaacctggattacttgcattacatggttatcaaagcgataaagaagcaacaagtacttttggtgctttagaattagcaaagcgtggttttgtcgtattggctatagaccattttggacatggctattcaacaaaattacctgcatcaaataagaacatgagtggagcaaataatggttatcaatatttgaaaactttacctttcgttgataaatcacgtttaggtatttttggacattccactggtgcattaaatgcaattcgtgttgcaaaactcaatcctgatcataaggctgtcaatggattaagtagtaatggcggtgacatggaactgaataactacttattaactcaaggcttatatgaagagataggcggatatcgtgaaaaaacattccctgttaaaaatttagttattcaccccaaccgcttaattgcttttggtttacctgaaaacgaatctttagaatgggatcatacctatggtagttttaaggatggttctgcacgccgtgctgctatagttgatggtacacaccttggtgtaatgattgcttctaatagtaataaagaagctatcctttggtttaatcaagcactacaagatggagaaaaaggggttgattggatagaagcagatcaacaaacatattggtataaggaattttcaggcttgtttgctttgggttcagctttaattgctacattattttttgcaaacggtttgttaaatagtgcttatttttctgttgtatgtaaaccggtaagcgagaaaactgcagttactgataaacaatggtggaagtttacaacagtcaatattgtattaactatgttactttatccattatttactcaatggggtggtgctaatgaacctattgcatctaaactgagttttatgccattagaaatgggtaatggcattattctttggttagtggtaagtagtatcattggaatcattttatttagtttatggaaaagaaaagttgctgtttcgctggcagaatttggtgtgactagccattcttcagtattaacgacaagtcaaattattgtgcgttatttacttctaagtatcctattaattttaggattgtatctactcacaagtttaatttatcaagcttttagtgttgaattacgctttctatggcctctattaaaaccattaacagctgaacgttttagtttattctttgtttattggttaccaattttagtgtttttcttcatttttaatggattaattgtttccgtgcaaatgaaacaaaaattggctacatcttttagctcaactctcattatttggagcataaaaacaaccatttttaccacatttggattagttatattgtggttattccattttgtccctaattttatgcaaataggtccagggtttgatttacttgggttaccacaattcggtggacgttggatgatgatgttagctgtgattattcctcaatttattgtatttactgtgatcaatcactggtgctatttgaaaacgggatacatttatttaggagtatttttcacctctctattaatgacttggattttagtaggtggtcaagtaatcggtcggttcctcgcataaaaattaattacttagaaaatttttaacgaagtagtaaaaagccctatttttcatgggtagggctttttgcaccctgcaaacccaaaattgcattaaaaacaagcggtttttgtttaaagtgcaatctattttaaggagaacacaatgaaaattgttattacaggaggacaaggttttttaggacagcgtcttgcaaagactttgttatccaattcaactttatcaatcaatgaattagtgttgattgatgtcattaaacccattgctccaaacaatgatccacgtgtgcgttgtttggaaatggatttaagaaatcctgaaggtttagatgaaattattaccgaaaaaacaaccgctctttttcacttggctgcaattgtgagtagtcatgcagagcaagatccagacttaggctatgaaatcaatttcttagcaactcgaaatttattagaagtttgtcgaaaaaataatcctaaagtgcggtttattttttcaagttctttagcggtgtatggtggcaatttacctgaaattattcaagatcacaccgcagttacaccacaatctacttatggttctcaaaaagcaatgtgtgagttattgatcaatgattattcacgcaaaggctttgttgacggcattgtagttcgattaccaactatttgtattcgtccaggaaaaccgaataaagcagcctcttcttttgtaagtagcattattcgtgagcctttacagggcgaagaagccatttgtccggtttcgtcagatttacgcctatggctttccagtccaaataccgtaattaataattttattcatgcgttaactttgccatcgctaccacagcgtagttggcacattattaacttacctggctttacggttagcgtaaaacaaatgttatctgatttagcttcaataaaaggtgaaaacatcttagaaaaagtgcgatttgaatttgatgaaaatatcaacaatatcgtcgcaagttggccggcagagattgataataaaactgctcttaaacatggctttaatgtggatgctgatttcaaagaagttattcaacaatttattaaaaacgatatgtaacttaggagcaacagtatgtttgacttaccaattccaatcattggactattgattgcggtatttgtcttagtctatttagtgttaaaaacacgtgttcatgcatttattgctatgctgattgcttctgcgattgccggccttgttggcgggatgtccgtcaatgaaactctcggtgccattagtaaggggtttggtggaaccttaggcggtattggtattgttatcggtttaggggttatgatgggaagcgtgcttgaagtttcaggggcggcagaaaaaatggcttacagcttcatcaaactgctcggtaagaaaaaagaagagtgggctttggcaattactggttatattgtaagcattcccattttcgttgattcagctttcgttattctttatccagtggctaaagcattggcaaaaaacggaaaacgttctcttttaaccttaggcgttgcacttgctggtggcttagtggtaactcaccatactgttccaccaacacccggtcctttaggtgtggcaggattatttgctgttgatattggtgctatgttgttagtggggatggctctcgctatattgccggttattggtattgttctttacgcaaaatggctagataaaaaatatccggaatttaaccaacaagttttcactcaagaagaattgaaacaaaaatacgatgactatattgaaagtcgtgagaaaaagaacttaccaagcttagggttatccttactgccaattgttttgccaatcgttctgatctttatcaaagcaatgtttgatttagctgcaaaaggtcatgtggaactggctcaaatgggagtttatcaattctttgcttttgttggtcatccaatgattgcattagcaatcagtgtattagttgctgtttatacattattaccaaaagcagaccgtgattcgaccgcacttcatctcgaagaaggagtcaaaactgcgggaattattttattggtaaccggagccggtggtgcattaggtgctgtgctacgtgacagcggtgcaggtaaacaactagcggaacaaattgcttcattgccaatttcaccaattcttattccgtttattgtttcaacccttgttcgctttattcaaggttccggtacagttgcaatggtaacggcagcttcaatatccgcccctattttggctcaaattccaggtgtgaatatgttgttagcagcacaagcagccacaatgggttcattattcttcggttactttaacgatagcttattctgggttgtgaaccgtatgatgggcatcaatgatgtgaagaaacaaatgatagtttggtctgtgccaaccacgattgcgtgggggattgggggtatcagtgtgattctctgtaaccttgtctggggtaacgatggctcattatttgatcttttgttccctattgctgtaatggcaattattgcattctacatcaagttccaaaatagaactttgaataaataatcaacgctcaaatagactatgaatgttattcgtagtctattttttaatctaagtgaggagtgaatatgaaaaaatattttattttggctagtggtttgctgttgtccactttgaccggtgcaatacctgatgaaattaaatctaattccaatgtgaatataactttgctcgcagaagtaaccgcacaagggtggagtaaggattgcctatcatcatttccattactctattaaattcttcatagaatctatgatttagagtgataatctgctgagcgtaaaggcttagtgtttcttgtgcactgtctaaatgattcattttcttccctcacaagcgattaaagctcactaattttttgaaatttacgcaatgataataaccccatatttgagcaccaaataaaaaatcactcaaatataattgacaaccattattattttattttaatgtgaatatgctgtagatcgttatagcaaaattatcaattaacaaaaaacaataggaggcaactatgcgtggacgtcgactaaactaattctataaaaaattatagaggtgatctaattagatcgcttctatttatcctctatataaataaggaagcatctatgaaatatatcacttctaaacatgtattttttgactatctaaatgaaaatgaatttgttattgggataggtagtaaccaagaaattacaaacaacaaagattattttaataattgtctaaatttatgttatttttgtataaatcctaagagcatttctgaaatattatcttttataaaagataataatatagacattctatatttcgataaaatgaagaaaatgaagtttattacaaaagaaataatagacttcaatgatagatacagtagaaatcatttatactataatgcattaggatataaaatatatgatatacaaaataaaatatctaaatctcatattcttattgttggtgcaggaggcataggaaatatttgctcctatttattaggaacaataggaattaagaagttaagtatcattgatgatgatatagttgaggaatctaatctaaacagacagttcttatttcgagagaaagacataaacaaaaataaagtagaaacaataaaaagagagttattatctattcggaaagatattattattgatattttcccagagaaattaaataaatctattttagataaaatatcacaaatagatttagttatttgttcagcagatgatgagtattgtatagatatgattaatgaattttgctgttttaataaaattcctctaattaacgtaggttacctcaatgatatttctgttatcggaccattctacattccaaagttagaatatagctgttgtttatgttgtgataagtctatatatttagaaaatgatgttatagatgaaaaagtgaagaaaattaaatcagttacgaaagcaccatctactatcattaataatttctttgctagtgctatgcttggttcagaacttattaaattctttgcacgcgattacaaatcaatgcaaagtattaattctgtaataggaattcacaataagaattttaagtatgaagaaattaagttagccaaaaattataattgcaaatattgtggagtaaataatgagacactatgaaaaaatcatcactagctgtgtatctacctctgcaacccgtatgctgattggggcggtctccacagtttatatgcttgtatcaggcattaatttatatgaagttgggttaattaaaagcactcaggctattttgatttttgtgctgggatttgcagtcggcattctgtcagaccgaatagaacgaaaatggctacatattaccgccttaattttttcgactttttggctctattttttctaccttgcgggtttatacaagagctttaacctctttttattagcagaaatcctcaatgcgatttctctctgtatttatcaaaacaataccaatgcttatttagtagatcagttttatcacgagcaaccgaaaggtgaactcagtcttgccttaggaaaattaggaaaatgggagttttccttgatggcattttctgctttattaggagggggcttatactctacgctatcagagaacctctttttattaacaacgattattatgtcgatcgttacagtcgcttcctttattttgcttcccaaggtgagcaggagagctacacataagactctaccatttattcaaaagcaggactttttaattcttatacgtaaattcagtcgctacaaacaagctattttcttatttgtggtgctaagcctctattttcaaattatcattcaatattggcaagcagttgtttacgccataaacaaatcagagcagaatggacttattctaggagggatgctatttttgatgtttatggtacaatcttgggcaggaaaagcaattgaggtaaaatatccattcagtcgcttaacccttgccttaagctttctcagtagtatggtgttatccttttttgcagaacggtggcaatcggtcttcttttacacaatcgccatttgcttagcattatttgtggtacgatatacagtgattcaaaccgacacagagctacatagacatttactctctcgctttagagcaaaatacgatatgctactcaactcattagtgagaattttaaccgctgtagtcttactgatcattggttatataagcaatctttatggtatacaagccattcaaatcattggattaataattgctatcatatttaccctttttgcattaataacttcacaaaatgtaaaatagaaaaaacttaacccattgtttaagatgagaaaatggatgtttttatagtctattttttaatctaaatgaggagtgaatatgaaaaaatattctagcaccagtattgcattattacaacaataagtatattcaagtgaaagtgtgtcctatgaaatacagaacgcagttcttgaattaaattaggttaacttaaaaacggtataaacctatgtaatcagttatcatattaaagatattagctcgttgggtttattccaaaccaatgagttttttcacagtaaatttctttatgtagttttagattcctactataacggggtttacattgaatagatatccatcaaaattagtgtcctctacatcggatagttcaagcaatttagttttaacattttctagatgttgccacattgctttacgtgccaaagcaggatttttgcgctgaatcgcatttaaaatcgtttcatgatctttaatccataagtgatggagatcattatgtatgatacgcgaatgaagctgtgtccacatagcattattaaaacgatatttccaaagttgctcttgagtttgaataaggacatcgtttccagtaatttcggcaagagcaagatggaattctttgtcagcactgcagtcatcaatattttgagcaaataattccttttctttatcaagaatttgcctaagtcgtaaaatatcttgtttggtaacctgttgtgcagcaaattcagcaatactgctttctaacaactgtcgtgcttgaagtagttcaaatgggcctacatctcttagcttattatccgcttcttcttgaagaagatctgggatttttatgacgtatattccggatccttttcttacttcaataatcttttccacttccaacattactatcgcttcccttacgatagttctacttacttcaaatctttcagaaatatttctctcggtaggtagcttatcgcctattttgtattttccttgagaaatttcctctttaagtatttttcctatttttgtgtaagttctagaattattttgcataaatcctcgcgatattggcacgccaaaataaatttatgtgatcaatatcacaattatagaaaattggaataccaaaaaatatactttgatgttactgtctgttcataaaatatcattgacgacattaaatgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtacaaatccgctggtaacttaccctagaattttaggacatgaaattgttggtacagtcattgaagctggtgttggtatgccaaaaaatattaatataggtgatcgtgtaattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggtgaacacgttgctatcatcggtgcaggtgcgattggactgatggccgcattagttgccaaagcttatggtgcgacaccaattttaattgacattttagacaagcgattagattacgcaaaatctattggcattccaaatataattaacccggcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaatgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaagtcttaactaacctatgaggtaataattatgaaactcaaaaaattaactaaagtattagttgttgcaggcttagtatttagtagttcggcatttgctaaaactgtaattaaaatcggacattttaattccgatatgcacccgtcaaatattgtattaaacgaagttttcaagaaaaccgttgaagaaaaaacgcaaggtcgctatgaaattcgtattttcccaaataatcaattgggcggcgaagatcaaatcgtaaatggcttacgcaatggtacgattgaaggtggaattaccggcttattgttacaaaatgtggatcctatttttggtgtgtgggaaatgccgtatttatttaaagacaatgttgaagcgaaaaaggtattggaatctccgattgcaaaagaaattggcgataaaatggaacaatacggtattaaattattggcttacggcatgaacggttttcgtgtgatttcgtccaataaaaaattggaaaaattcgatgatttcaaaggattacgtttaagagtgccattgaattccttgtttgtggattgggcaaaagcaatgaatattaacccgcaaagcatgcctttaagtgaagtctttactgcattagagcaaaaagtgattgatggccaagaaaatccatatatgttgctcaaagattccggtttgtatgaagtacaaaaatacattatccaaactaaccatattttctcaccgggattattgcaattaagcttgaaaacttggaataaaatgtcaaaagaagatcaagaaattttcttagaagcggctaaattatatcaagagaaagaatgggaattagcgatgaagatggaacaagatgttaaagacttcttccataaaaacggtaaagaagtaattattccgtccgagcagtttaaagcagatatgttgaaagcctctgaaacactttatcaaaatttttatcaaaaatatgattgggcaaaaggcgtgattgaaaaaattcaagccgctaaataattgaactcataggctgtttgttagcaaacagcctttttcctatcgctttttaggagataaaacaatgaaattttctaccgcacttgaccgcactttaaagatgttggcagtgattgcattagtgacaatgattttattggtcttttttaatgccatgctacgttattttttcgattcaggtattgcttggtcggaagaatttgctcgaatttgtttcgtctatatgatttttttaggcattatcttagttgccaaagaaagagggcatttgactgttgatattgtgatttcttatttacctgcatacgtacagatgtatgccttattttttgctgatatattagtgttgcttgccttatcttttattacttatggtgcatatcaattaatgttgctgacttatacacaaaaaatgcccgcaacggaaatttctaccgcatttttatatttagcagctgtgatttcttccttatcttattttctcgtggtttttaccaatttatggaaacatttaaaactggcatttagaggagggaaagcatgatgttaggattatttttaggtagtttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgctgactggtgaaattatgaaatacggcggtatttctgagcggattatcaattttgctatgagtatggtaggacatattaaaggaggattaggttacgtagtgattatttcaggtttaatctttgctgggttatctggttctgctgtagcagacaccgcagcgttaggtgcaattttaattccaatgatggtagctaaaaaatatgatgttgctcgttctacaggtttagtttgtgcggcaggaattatttcggtggtcattcctccaagtattccaatgattgtatatggaattaccgcaggtgcatccattaccaaattatttatgggtggcacggttcctggattattaatggttacaggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaagtctttttaaatacgattaaaactacttcaatggtgatgtttgttgcggccgcggcgatgatttctgcatttgcaatcacggttgctcaaattccaacggagttggtgcaatttatcaaaggattaactgacaattcaacggtattaatgttggttattatgattttcttattactcgttggttgtgtaatggatttaattcctgcagtattaatttttgtacccgtattattgccagtattgagagcttacaatatcgatattgcttattttggtattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtaccaatgaattggttatcttagtggtgcttattatatccattgttataaagacaaagttgtcgtaatgacagaagctggcaatatgaataaagcgatattttgtaataaaaataacgtataaatcgcaatttttacaaattgatttgacagaaaagatattcgggtgtaaaacattttttacatttcattaacattttggaacgttttatgctcaccattcatcatacgagtgaacaatcacttctctgtgaaattgctcctcctgctgaacttgccaagcaacagcgaatttggcaaattgcagagcaggctcggcaacttgccaatgtgcaagaagtagtggttggtatgaataattttactgtctattacgatttatttgcagatagtcaaccattaattgaaagcctgcaatcattgtgggaaaattatcaaccacaatcagttaaaacaccacgctgtattgagattccagtgcattatggtggcgagtttggtgaagatttatttgatgtagcacaatttcaccaaactacgccaaaagaaattattcgccgtcataccgaacctgtttacactgtgtttatgatcggttttcaagctggatttccttatctaaacgggttacctgaaaatctttatacaccaagacgtgatatacctcgtactaaggtgcctgcaggctccgtcggcattggcggtagtcaaacaggaatttatccttttacctcaccgggtggctggcagttgctcgggcgtactgatttagcactatttgatattcaacaatctccaccaacactattaagtgcgggtgataatgtccgttttgttgcagagagtattcaactatgatctacattaaacaaatacaaggttttgctcatattcaagatttaggtcgttatggctttcgttctctcggtattggacacagcggtgcaatggattctttggctttacaagcaggcaatttattactaaaaaatgcaaataacgctccagcaatagaaattacgcttggtggaatgagtttgacatttgattgcgatactccattttgttttactggtgcattagtagaggctgaactggatggcgtgcctgtattttcctactttcgttatactgccaaagtgcgtcaaactttaacgcttaaacgtattataaaaggtaattatacttatctttgcgttgctggcggttttcttgtaccacaggtgcaaggctcagccagtactgatcttagagcgcaatttggggggtatcaggggcgtatgttaagagcgggggactgtattcccaccgttttgcgtgatatacagttatcatttctcagcattgaaccaattgattttactcataagattgggacgacactttcgtctgaatatgaggcatttactactgaaagtcgtgagcgtttcttccaacagagatgggttctacaaaataacagcagtagaatgggctaccgttttgcagaaaattcgttaaaactgaccgcacctcttgaaatgctttcctatgcggcacctgctggcacagtgcaagtgccacctgatgggcaacctattgtactaatggcagatgcacaaactacaggaggttaccctaaaattgcttgcgtgattagtgctgatcttggaagacttgctcagacatcgattggcagtgcggtgcagtttgaattattaagccgaaaacaggcggtggcacgttttaaacaagatcagaactatttagaggatattcggagaaaggtaaatgaaacagattgatttaaatgtagatcttgctgagggctgtgccaacgaccagcaacttttacagcttgtcagttcagcaaatgtttgctgtggattacatgcgggtgattacaacgaaatacgcgaagcgattttgtgggcaaaagaaaacgatgtacgaattggagcacaccctagttttcctgatcgtgaaaattttggtagaaccaatatgcaattgccagatgatgagcttaaggcttgtttattttatcaacttggggcagtcaaagcattatgtgatgcgtctggtgtgacgatggaatatgtaaagcctcacggagcattatacaatatggcagcgaaagatcctcatttagccgcacttattgcagaaacagtgaaaagtgttgatccttcgcttaagttaatggggctttctggcagtatcatgctgaccgttgctgaacagcacggtctagcgactatctctgaggtctttgctgatcgacattaccttgctgatggttcacttgtgcctcgtactcgtgatgatgcaatggttgagaacgatgaggaggctatttctcaagtgttacaaatggtgcttgaaggtactgttccaactgttgatggcggtaatgtggcaattaaagcagacagcatctgtttacatggtgatggtgaacatgcagtcgtatttgcaacgcgtattcgcagagagttaaaggagaaagggattttggttacaagttcaatttagtaagaattttactaaaaataggaatagatgttatttgttctagtcgcctttcttttggttgtttttcttttacaaagcaaagaaaaatagccttgatttctaaaacaaaacataaggaaaacacaatgtcaaacaataaccgcagtgcccttattggagcggcatttttaatggcgacttcagccattggaccgggtttcttaacccaaacagcgacatttacccaaaacttatttgccagttttgggtttgtgattttgctctctattttgcttgatatcggggctcaattaaatatttggcgaattattgccgtttccgaaaagaaagcccaagatgttgctaatgcagtattgccgggtgcggggtattttctcgcattgcttattgtgatgggtggcttagcgtttaatattggtaatgtgggtggtgcaggcttaggtttgaatattcttactggagtatctcctgaaaagggagcaattatcagcggtattattgctgttggtgtattcctatttcgtgaagctggtaaagtaatggatagatttgctcaaattatggggtttgtgatgatcgccttgactgtctttgtggcagtaaaagccaacccacctatcgctgatgccgttgttcacactttcttacctgaaaaattagatgttattgcgattgtcacccttgtgggaggtacagttggtggctacattacttttgccggagctcaccgtttattagatgcgggcattaaaggaaaagaaaacttaaaagaagtgagcagaagttctgtttctgcaatcttaattgcttccattatgcgtgtggtgctgttccttgcggtattgggtgttgtttcaatgggtgtccaactggatccaaaaaacccagcctcaacaccatttgcttacgttgccggtaatgtcgggttaatgattttcggtatcgtaatttgggctgcatctattacctctgtgattggtgcggcgtatacctctgtatctttcattacctcattttcaccattcatcgaaaaacacaaaaattgctttatcgtggcatttatcgtgatttctaccgttgtgcttgctaccataggcagaccagcccaagtgctagtgttcgtaggaacattaaatggtttaattttacccatctcactcggtttagtcttattagcagcttataaaacaaatattgttggtaactataaacaccctatttggatgacaattgcagggactattgttgtcgtaagcatggcaattttaagtattataactctctcaaaatatgttttggggctgtttacttaattgatttaaggcgatgatagcaattttcggtttctctttacttggaagagaaacctttttccattatgatcttgtctaaatttaacgttgctgtgtaaacatatattgcaaatgtataaaaatctatccttacttttacttgatgatttgttcgatttagaattagttgcgggtcttactcaatgtgagaaaggtaattaccttgattctatggtagatagacaacaaggaatgagtggctatatgttacaattaactacttttggtacaggcattatttttgatggtaaacattctttttccactcatcgaggacaattgctactattcacaccaagtgcggttcaacattatcacagacatccagaaagtcagtattggcactataaatggatctattttttaccaaacccaaaatggaataaatggttaaattggtcaaatatggaggaaaaaatagggcgtattaccattggtgatgaccgctactttcaggaaatcagtcagcttttcagcaaaattgaagtcgaattgaaatcaagtaaattttttaaagaagatgtagccaccagtctattagaatacttacttatgaaaagtatttccgccgagaaaattgaagttattccagtaattgatcagcgtattttaaatgtttgtgatttaattttgaccaatttggctaaaaatgacagcttagaagcactagcaaaaaaagtatttttatcgccatcaagattatctcacctttttaaacaatctttgggtattggcttagtgcaatggagagaagtacagcgtatttccgaagctaaaaaattactttatttctctaacatttctatctcaaatattgctaaatctttaggctatgaagattctctctacttttcgaaaattttcaaaaaacacaccgcactgtctccgtctaaatttagaactttagaaagatgtaaaaacaatgaaatgtgatccagatctcactttactttgtatagcagaattttccatattgataaaaaaaagttacctatttttccctcacacaaaagcataagataaaaatggctttaatagtatggtttctattagagaggtaatatcaagctttttatacgatattcaattaaaggacttcttattttatgagggaagaataatgaaaaaactcactttaaaacatacattattttcaggtattttagcactgacttgttatggttcagttcttgctaatgacgtagttaatatttctaaaattgacggtatgccatggtttaatcgtatggcagaaggtgttgtacaagcaggtaaagataacaatattaatgcttatcaagttggaccatcaaatacagatgctccacagcaagtgaaattaattgaggatttaattgcaaagaaagtcagtgctatttcaattgtacctaatgatgcaaatgccttagaaccagtgctgaaaaaagccaagcaaaatggtattgttgttttgacgaatgaatctgtaggtcagccaagtgcagattgggatattgaaattattgataatgcccagtttgctgccgattatgttgaagaagtcgctaaagcaatgggcggtaaaggcggatatgttatttatgtcggtggtttaaccgtacctcaacataatttatgggcagatctatttgtaaaataccagaaagaacattatccagatatgtttgaagtaaccagcagaatgcctgttgcagaaaatatcaatgatgctcgccgtaccacaattgatttagtcaaagctcactctgacttaaaagcagtagtctctttcggttcacaaggtcctatcggtgccggtttagccgttaaagaaaaacgcttgaaaaataaattaaatgttttcggtatgatgattccttctcaagctgcaaatttaattaagagtggtgatattacgatgggtattacctacgatccagcaagtgcgggttatgctcttgctgcagttgctgccaaagtgttgaaaggtgaaaaaatcgaagatggtttagaactccctaatgtcggtaaagccaaagtggatacagagaaaaaactcctccaattccataatgtacttaaagtaaccaaagataatatcgacaacttatattaatctatattgaatatgggttctttctgaacccatatttctctcaggaggctttatggcatttattttgatgcaaaatatcaataagacattccacggtgtaaaagccttaaatcaagttaatctctctttagattatggagaagctctctgccttgccggacaaaatggttgtggaaaatccacgctaatcaaaatcctctcaggtgtttatcaaccggataaaggggctgaaattcaaattggtgcgagcaaatataccaaactgacgccacaagcttctattgaacagggaattcaagtaatctatcaagatttagccctttttcctaatttaactgtcgctgaaaatattgcaataaatttacatcgaaaattaggttgggtcagccaatcagaaatttatcaagttgcattaaacgcaatacaaagcattaatgcagatttagatctcaatgctattttagaagatttaccaattgcacagcaacaattagtcgctatttgtagagctcttgcacaaaatgcccgactgttaattatggatgagccaacagcatctcttacagcgaaagaagtacaagatctgctaaaagttgtactcaagttaaaaagtaaaggcattagtattatttttgtcagtcataaattacaagaagtaatgagtgtctctgataccgttttagtacttaaaaatgggaatatggttggacaataccctattagtgaaatggatgaaaaacgcttaggattcttaatgacaggcttggaaattgactataaacggttagatttgcccgatttttcgcaaaatagaaccgttttagaagttcaaaatttaactctgcctaaccagtatgaatccattaatttctcattaagagaaggagaaattattgccttgaccggtttactcggctcaggtcggacggaactgtgccttagcttatttggaatcactcaacctaaatcaggtgatattctattaaatggtgagaaggttatatttcaaaacaaccgtgatgctatcaaacaaggaattgcttatgtttctgaagatagaatgacaactggtttaattatgactgaatccatacatcataatattatctctactatttttcataaaatcaccgataaatttaacattataaaatcatcaaaagcctataattatagccaggaattaattgaatctttaaaaattaaagtaacggattcagatttgccagtaaatacactttccggtgggaatgcccagcgggtgtctatcgcaaaatggttagcaatagatcctagaattattattttagatgctccaaccattggggtagatattgcgaataaggaaggaatattccaaattattcgcacattagcacaaaaaggtatcgctgttatttttgtgaccgatgaggtagaagaagcatactacaacagccacaaagtcatagtaatgaaaaaaggtaaaattgtaggtgagatattacctatctataccacagaaaaatcaattgcggaggttgtttatgaaaatcaccaataatcatattttatctacgacaattttgatactggcaaccttattaagtctattcacgaatgacttcgctaccattgagaatatctatgatgtagtcaataactattcaatgctaatgattttagcttgtgggttgtttgtggtgttactatcaggtggcattgacatctcatttcctgctatcaccattatttcacaatacattatggtaacggctataggcaaatatgatatcggttttttcggcgtatttgcagtatcatccgcaataggtatcttacttggttttattaatgctctttttgtaaaccgccttagtgtaccttcaattattatcaccatctcaacattaaatattttctacggaggactactctattttaccaagggtgtttggttatacgattaccctgaatggttcacccaagaattgctatttttcaaacaaacctcgcaagatggttttgaattcggtttatcttttcaagcgataatggcgattttatctatattattaacttggttgatcactagcaggttaacaataggaagaaaaatttatgcccttggtggaaaccaagatgccacctctcgtattggttttaatattttattccttcacctatttgcttacggctatatgggatttatggctggaatggcaggtgttgtgcaatcttatacagtgcagtctgttgcccctgactctctacttggttacgaattaattgtactagcagccgttgttttagggggtgcaagtttatctggaggaaaagggacattatttggcaccgtaatgggagtaatgttactagcaattattcaaaatgggctgaaccttatgaatgtatcctcgtattggcaaacgataattaccggtatcattatcatcttaagtattagtgctactgcattagggcaattgaaaaaacaaggagtataacgatgagaagcaaatttgatcatactattttttatctgttggctctttttattattactgttattgcctttagtattttaattccagatattttttggtctgtgagtaactttcaatcaatggcatcgcaaattccagtcttaggaattttaactcttgcaatggcattacctatgcttacgggaggaataaatctttctattattgccagtatgaatgcttgttcattaattattgcttgttttattacgaagcatgcagggatttcttggctatttctatctattgtattaagctttttatgtgcattaattattggggtgatcaatggtgcactgattgctattatccgagtttcaccgattctagccacgttaggcacaatgacattaattaatggcataaatatattagtaacaaatggttcaacggttgctggctttctagaaataatactgagtattaatacctcaacttttttatggttgccactgcctattctgatttttttattccttgctggacttgtttggtttttcttagaaaaaacttctatgggtaaagcggtttattttatcggcaataatgaaaaagccacatattactctggcattaataccaagaaagttctaatttggatatatattatctcctctgtactctgtgtattcgcagcccttttaatgatgtctaaactcaactcagccaaagcatcgtatggagattcttacttgctcatttccattttagcggcagtactaggtggatttaatcctgatggcggcaaaggaaaacttatcggcattatgttggctcttgtattactacaggttattgaaagtggattaaatatgttaggtatcagtagttatattacgatgattttatggggtagcttattactactgtttatattcttacaaaaaaatcgtcttttcctattaaaaaactaagggatgtacgttatgcaaaatgaaaaacagcttattgaacaaggtaatatcgttattggtattgaattaggttcaacccgaattaaggcagtattaattacctcagatggtactattttagcaacgggtggagcagattgggaaaataggttaattgaaggagtttggacataccatcagcatgagatatgggaaaaactacaagcggcgtatgtagatttgagtaagactgtaaaagcaaaatatcacaccacaattcgtactgcaaaagcactgggaattagtgcaatgatgcacggttatttgccttttgataaacagggaaatcagctggtgccttttagaacatggcgaaacaatataactttaaaatcatcggaaaaattaaccgcactttttcaatatccaattcctcaacgttggagtattgcccatttataccaagcattactcaataaagaaccgcatttatctgaaattgattatattacaactctctcaggttatgtgcattggcaactaaccgagaacaaagttttaggaattggagacgcttctggtatgttcccgatagatactgagatacaatcatacaataaaactatgctgactcaatttgatcaggctgttattgaatatcagatgccttggagattagatgccattttgccaaaagtattagtagctggagaacatgcgggtaaattaacttttaaaggggctaaattacttgatccaacaggtaacttacaggctggtattccactttgcccgccagagggtgatgcaggcacaggaatgattgcaaccaattgtatcaaagaaaaaacaggtaatatatctgctggtacatcagcatttgctatgattgttttggaaaaagccttatcgaaagtctattcagaactggatattgtaactactccggcaggtaaactagtcgcaatggcacatgcaaataactgtacttccgatattaatgcttggataaatttattcggtgaatgtttagctacttttggtgtttatgtgtgtatggaagagctatatgaaatgctttttctgcatgctttgcaaggtgagccggattgtggtggattactatcttacggtttttattctggcgaacataatgttggtttatcggaaggttgtcccgtttttttgcatccaaccaaagctcgttttaatttggctaactttatgcgtacgcatttttatactgcttttggtgcaatgaaattaggaatggatattttgattaatcaagagaaagtggaaatttctcgtattctggggcacggaggtatttttaaaactgaaggggtcgctcaaaaaatattgtcttctgcacttaatattcctttagcaactgcaagcacagcttcaaatggaggagcttggggtattgcactactggcgaattttcttaccatttctaaaagatataatttagaagaatatttagataattgtattttcaacacaactaaacttaatcttattcaaccggataaaataatgagtgaaggctatgaacgatttatgcaacgttataaacaaggtatttcaattgtggaaagtgcactttttttgaatcagtaaagttataagcacatagaaaaagcttatgttgtgacgggctgaatcggttgtagaacatctgcccataattggttaataatgttacttaactgttagggcagattgatttttacctgtatgattatgcaaaatattgtgctagatcgtcacttccgccaatatattgcccaccgataaacacttgtggcacacttgttttacctgtgattgcacgaacagaaattgtactcgcatcacgacccagtatgatttcttcaaaggtatagcccttttcttttagcaatgtttttgcttttgcacagaatggacagccgggttttgtgatgatggaaactgaaggtttttctgtccaatttgggtttaagtatttaatcattgtgtctgcatcagagactttaaatggatcgccaggttcttgtggttcaataaacattttttcgactacgccattttttaccagcatagaataacgccaagagcgtttaccgaaaccaagttctgttttatcaacaagcatgcccataccgcttgtgaattcaccattaccatcgggaattactgttacattctcgctttcttgatcagctttccaagcattcataacgaacgtatcgttaactgatacacaaataatatcatcaacacctaacgctttaaattcacatgcaagttcgttataacgaggtaaatgtgttgctgaacaagttggagtgaacgcacccggtaaagaaaataatacaaccgttttattgtcaaacaaatcggcagttgtaacatcaacccattgatctccttggcgtgtacggaatgttacttgaggaactttttttccttccatagtcataattttttctcctatataaagattagttgataaaaaatatgattttaagtttaaactatgttatagtcaaaaacaatcaaaaaaagttatttaattgttaatttctatgataggtgtacagaatgaatattcgagatttagaatacctagtttctttagctgaacataaacattttcgtcgtgctgccgatgcttgttatgttagtcaacctactttaagtgggcaaatcagaaaattagaagatgagttgggtatcgtattactagagagaacaagccgaaaagttttatttactcaatctgggttgcttttagtcaaacaagctaaaactgttttacgagaaataaagctattgaaagaaatggcaagtaatcaaggtaaagaaatgaatggaccactacatatgggtgtcattccaactattggaccctatttattaccctatattgttccggcactaaaaaatacttttcctgacctagagctatttttgtatgaagctcaaacgcaaaagcttttagaacaattggaaacaggtcacttagattgtgtcatattggcatcagttgatgaggctgaagcctttattgaagtaccgatgtttaatgagagaatgctactggcagtttcagacgaacaccctttatcaaaagaagattcgataaaaatggataagctgaaaggatatgaaatgcttatgctggatgatgggcattgtttacgaaatcaagccttagattactgttttgctgctggggcaaaagaaaatcagaattttcgtgccacaagtttagagacattacgtaatatggtatctgccaatacaggtattactctcattcctgaactggcactcttaaacgaaggttcgagaaaaggaataaaatatctgccatgtttctctcctgagccatctagaggtatttctcttgtttatcgtccaggctctcctctaagagggcgatatgagcgaatagccaataaagttagtgaaataataaaacctttactaaataatagaaaaaacggtaattgaggtataacagctatataatagctgtataaatatctaattgtttggaaaaactaaaattacatcagggataattctgttggcttttaagtctgctatagcaattattaattccaatttgtttttaggctatttttttaataagtcacgaatctctgttagtaatttttcttcgtttgaaggtgtaattaccttttctacttttggttcttctttcttcaatttatttaatgctttgatcattaagaaaattgcaaatgcaataatgataaaatcaaatatattttggataaacataccatattttaacgtcatagccggagttttatcggttgcttcttttaaaacaatatgtaagtctttaaaatctacgctactggtgaaaaaacttaatatcggcatgatgacatctgctactaatgagctgacaatcttaccgaatgccccaccgataatcacaccgacagccatatcgataacattgccccgcatggcaaactcacgaaattctttaataaaactcatcacatactcctaaaataaacaaatataagtttgaatagatcgtaaaaactttcagtttgatgtatagaaaattgatattattctctaaataaagaaagcattaggttgaaaaagtttctctatttctgttacatattttttatcacttaaataaacaatgatatgatcgccactttcaatgactacatcttttcttgcgatgatcacagtatcttgtcgcaaaatcgcaccaataattgcaccattgggtaattttaactctctaagtttacgtccaattacttgtgatgttgtttcatcgccatgcacaataatttccaatgcttcagcaatgccatgacgcaaagagatcgcatttgcaatatctcctttacgtacatgccccagtaaagcggagatggtagcttgttgtggagaaactgcaatatcaattgttccgccttgaactaaattgatgtacgccatacgctgtattaacaccattgcttttttagctccaagatgcttagccaagaatgccgacataatatttgtttcatcatcactggttaaacataagaaagcgtcaatgttttcaatatgttcttcaaacaataacgatttatcggaaggatctccatgcaatactaaggttttagataatttttccgcaagtgatgttgcacgctctgcattacgttcaataagtttgactgtgcagtgattttccagtttttttgcaacacccacggcgatattacctcccccaataatcatcactcgtttataaggtttttccaagcgttgcagttctgacatgaccgctttaatataaattgttgcacaaataaaagttacctcatcgccggcttcaataattgtcgaaccctgcggacgaatcactttatcttgacgcaaaatagataaaatacggcaatcaatatgcggcatatggtcttttagggcggaaagagaatagccaaccaaagggccaccataataggcttttactacaacaatactaatattttcattagctaaatgagctacttgtaatgcaccggggtaatcaattaagcgagagatttcttcagtaacaagttgttccggtgaaatgatatgatcaatagggatcatgtgcggttgaaataatttatctttttcacgccaatattctgcatcacgaatacgtgcaatttttgtcggagtgttaaataaggtataagctatttggcaagaaatcatattcgtttcatctgaacttgtaacagctactaataaatctgcgtcaggtgctcctgcttctcgtaaaattctcggtgatgatgcagagccgttaatcacttttaaatcatgtttatcttgtaaatgtgccaaacgaacagcgtcattatcaattaacgttatatcattgtcttcactcactaaattttcagcaagtgttgttcctacctgaccggcacccagaataataattctcatcaattccctcttttaatttatacagattgaatacctttatttttcatatttcaacttcacattaatttctgataagttttatgattaattgggcagttttcttaatttggcataataaaaaccgtcacctccctgttctgttggaacaaattgatgaccaatttcctccccaatggtaaaaggcaaaggttctaattttgcatcattgtgcttggctaagaaatgctgaatttgttgactattctcttcaggtaataaagaacaggtcgcataaactaaaataccttgtggttttaattttttccaaagggcttctaaaatttgtccttgcaattgcactaggggagtaatatcactttcttggcgtagccattttatatcagggtgtcgacgaataacaccggtagcggaacaaggagcatctaataaaattcggtcaaattgtaccgcactttcagatttaaaggtcagtcctatagcattaaaatcaatctctgataaccattgctccggctgggttgcatcaccacaaattattatagcttgttgtttcatacgaactaaattttctttcacacgttgtagacgagcaggttcaatatctaaagcgatgacttttgcgttgggtgcttgttctaaaatatgtgtagtctttccgcccggtgccgcacaagcgtctaaaataagttcgtcattttccggttcgagtaataaggctgaccattgtgcgtgtagatcctgaacgctcacccatccttgttcaaaatagggtaataaattgaccgcacttgcgtgatgtaggcgtaatgcttgtgggtgattcgttgttgatgtagatattcctcgctccattaaaagttgttgataatccgcaatagaacaatgttgtaaattaatgcgtagccacatcggaggtttttggttattcgcttcaacaatttcacgccaattggcataagattgttttagtttattcactaaccattccggatgtaaggtttgccaatgcttatccactatcgccagaatttgttcttgttcccgcaaaaagcgacgcaaaacagcatttaacaggccacggaaactatctgattttaaacttttcgtggcagaaacgacttcgtccactgcagcatgagcaggaattcgggtatataaaatttggtataaaccgaccaacaacaagcaatgtacgatccgagttttacctttcaaaggcttatccagtaggagttgaatgatgcgttctaagcgaggtaacacacgacaaataccaaaacaaatttcttgtagtagcggaaaatcttgcggtttgaccgcactttgttgctcaggcagcaaggtagaaagggatttaccttgaactaaaacttgtaaaattacttctgccgcaagcacacggactgagcgaggcgtgaaaagtgcggtagatttgaccgctcttttagttttgttgtgctgagatttgctcataggacttgtcctatcttaaaccaatccgcacggctgtttaataaatctcgtgctgacatcggttttttacctgcaggttgtaattgctccaagtttaatacaccatttgctgtcgctacttgaatacctcgtttatctgctgcaagaatggtgccacaaggcttattttgatgaggtaacactgaggcttgataaacttttaacgtttgtagcgtgccttgactgtcttgtgttacaaaataactcattggccatggattaaacgcacgaatacaacgttctaattgttcagcggataaagaccaatctagtttagcctcttctttagaaagtttttctgcataattactcagactttcatcttgtacttccgctttaaatagaccttgttctaaaccgtccaaaacctcaagtaaggcttttggtgcaatgttagccaatttagtgtaaagggaggttgaggtttctgtcggtgtaatatcacaacagactttatgtaacatatcgcccgtatccagcccctcattcatttgcataatggttacccctgtttttttatctcctgcccaaattgcacgttgaataggtgctgcaccacgccaacgaggtaaaagcgaaccgtgtacattgagacaacctaaaggaaatgtttgtaacacagccaaaggtaaaattaacccataagcaacaactaccatcacgtcggcattcaatttactcagatgttcttgcacctcaactttacgtaaggatttaggttgataaacgggaatatgatgtttttcggctaaaattttaaccgcacttgcccgcaatgtttgccctctccctgcaggtttatcgggctgcgtgtaaacagcaaggacattatgttgagattggagtaacgcttgtaaatgttgtgcggcaaaatctggtgtaccggcaaaaataatatttaatggtttcataagataagctaatgttctacgttatgtaattgataaaaataaaaggcggacgatccgtccacctattgtttaatttaacgattttttgcgatctgtttttgcaatttgagtagtttttctttcatgcgttggcgttttaatggcgacaaatgatcagcaaaaacaataccatttaaatgatctatctcgtgttgaatacaaatggccaacaaaccatctgcatctagcataaactcttctccctgacgattttgtgcttttacttttacagtctctttacgaggcacaaaaccacgtaaaccaggtaatgataggcaaccttcttcaatacctgtttcaccgaaactttcaagaatcttagggttaatcaacacaatttgattttctttagttccttcaatatcgatcgtgataatacgcttatgtacatttacttgtgttgcggctaaaccaatcccttcttcgtgatacatcgtttcaaacatattatcaataaaggtttgtaattcttcgtcaaaaacgcttacaggttctgcgaccgtttttaagcgttcatcgggataaattaatacattcaataatgccataagttcctttcatattttatgttataaattcaaattgaattcattttactcgtttttataggcttttttaagaaataaaataaggaaatgggaaaatatctcaactgagatgcgtaaaaaacttcagcgagagcgatttaccggcaaaagagcggtaatttctaccgctcttttttgggaattgtgttatacgcctttatgttggaagtacaaaactgttgcggcaacccgagaatgaacgtttaatttacgtaataaattgcgaatatgtacttttacagtttcctctgaaataaataattgtcctgcaatttgtttatttgctaatcctgtcgcaatgagtgccagtacattcatttcccgatctgtgagggaataaataggatcatctttatgttgacgttctaacagtaaatttttgatcgattcactgagaatgacttcgccttgtgtaactcgttttatctgagagagtagggtatccggttccgtatcctttaataaataaccgtcagctcctgcatcgattaatgtgaaaatatcatttttcgcatcagaaacggtaagtattagaattcttgcatcaattccttctgtgcgtaaagcctttaatgtatccagtccggataatcctttcatatttagatctaaaatgatcaaatcaggttctaactgcaatgccagatttacaccttcacttccacttccggcgtcacctatgacttcaaaagattcatccagctcaagcaattgtttaatacctcgtcgcatcaaaggatgatcgtctattaagagcacttttgttttgtcagacattgattttgtcctcatcatgagagtgcaaggcggctatgaaaaggcacgatttttgttccaccgttgcagtccggtaataattgataaaattgcggatagttaaaattatgctgcacgattttatatgggttgttgtttttatccaagctcgccgattgataaatttgatttatctcacgaattttctgttcttttgagccttcacaatgtcgatagatttcaatgtggttttgttcgtctaaaatatagacattaaaacttttatcttcattatcttcaaagaaaaattgtaagaaaccttcgctcgcaaaagcatccatttcataaggataatgtttctgttctgctaaaagtgcggtttctttttcctcaatagtattacgtagttcattatcaaatacactattatttatcgaagtgttttgcatttcctgtaagctgagtccacgctcttcaaagaataattgccagtttttacccgctattctcaacatattatttttgggggcatcggtatcaccaattcgtatatcaatatattttttgataagtgcatggacaatattgcataaggttttttggtagtgttggctgtaacaaaagacgttaattgattttggcggtgttgagccgggataaaatttgtttgataacacttttaatgctaatagaatggcattggcaccctcaaaatgcaaagtgcggatctcattccagatatttctataagtgaggtcaatacttcctacgagactttcttctgaaggcccaaaactgaataagtcacttggtaaaatagtcgacttactttgcaacaaatgagcagttggatcgttagttaaattgattgtaacggagagatgttttattttgcattgtcgagttaattccttatttgttgcttttttagtacgggtaatagggaaagataaacgcaaatcagcaacgaaattacgtagcgttttaagagatacagtatcactatgaatataaagcgaagtgattggtgtaagcaacccattaaaataggcccatgaaactaatttatttagattttcgccatattctatgtggcgtttttgacaaagtccttgtacatccggtttttgtgttactaaataccaaccggctttgaagaatttattttgtttcacttcaatgaatgttaagtgcggttccgataaatcaagggaaatagcttgattgagcaaggtgatttttcccggtaattcttcaaaagcagtgtaaagttttctggtcaagatagaaacatcttgtggcatgatactggcatttacattatgtttacgcccgaagttaattagatttcgatagctcaacataaggtattgcatcaggtcattgtgactttccttaacttttttgattttccaagttgtacgttgatttagattttgaagaagattatctgaccaattccactgctgtgtaagttgatgcagtttttctgaacgccaattattttcttgttgttgaacgatatactcactggctttcatataaaagcaacgtctcacaaaatctaatcttttgaattcattcagttttgttaaaaaagaactcactcgctccaacattgctaagtatgggtcatagtgatagtcaagatcgttattcagcagacgttgtttgaattcttgtgcaattaagtgagtatttggatattcataagaataactttcgagtaataagattttgagtaccgatttatagggggaatcgatacctttatatagttgccatagacttgcaccaaaatattcgttcgctgaaaacgcactcagacaaccaaaatctacccaatcatctatattgatttgctttgttttgatgagtcgattgacttcagaactataatcttgttcatttgctacctttagatgtaaccaaagtagcggtttaccggcaaggcgaataacagaacgatagaactcctccagtaataacatatattgtgcggagccactattttcagaagtaagtgcatcggcataacgaaagctacgaaaacgctgttggtcaactaaataaagattaatttctacgccaagacttcttgcccattgttgcaataagtgatttttttttgaaagttgttctttatcttctaatctaagatcttctcggtggcatacccaaatatctaaatctgagcttggtgtttggctgatagaaccgatacttcccataacgtaaacacctaaaataggcgtgtctgtgagatgttgtaatgctgccaaatgtgtactaagttgctcaaaatctccctgagggagatgtgtagttaaaaattcctgttggtattttgataattgaaaacgagcaatgccatgtggggcattcggtaggtaaccgcccatcaagggatgatttatgtgtaacaataaggtaagaagttgtaatacacgttggaactctactgaagttgaagatagtgctctttctaaacgtaactgatcaacaaattcaacttgtttcttcgcttgttggagatcgtatttcaagttattctctatctagataaattaatcgttgcttactctatcactccccttgtatgaaagcaaaaaaatcaagtaaaaaattaaatctacactgacatttcagagtaacagtgataggatattgcgattacgagtctaatctatatttctacatatgagtatcaacaagaccctaaaaattgcgacacgtcaaagtccgttagcattatggcaggcaaattacgttaaaaatcgcctacaacaacgttattctcatttaagtgtcgaacttgtccctatcatcacaaaaggcgatgttatcttagatacacctttagctaaaattggcggaaagggattatttgtaaaagaattagaaaatgcgttgttaaatggtgaagcggatattgcggtgcattcgatgaaagatgtgccaatgcaatttccgaaaggattagagctaagtgtgatttgtccgagagaggatcctcgtgatgcatttgtttcaaataagtaccgcactttagacgagttaccgcaaggtgctattgtaggaacatcgagtttacgtaggcaatgtcaactcaaaaactggcgagcggatctcgatatccgttctttacgtggtaatgttggaacaagattaaataagttagatcagggtgattatgatgcgattatcttagcttcggcaggattaattcggttaggattgactgaacgtattcgctcttttattgaaattgatacgattttacctgcttgtggacaaggtgcggtaggaattgagtgtcgggtagatgatcgagatgtgcaatctttattgatgccgttggctgatcagacgacaacttattgcgtattggcagagcgtgcaatgaattttcatttgcaaggtggttgccaagttccgattggtgcttatgcaattttagagaataatcagttatatttgcgtggtttagtgggagatgttcacggttcacaaattctatcggcagaagggcaatttgaattatctcttgattttgaatcatcgcaaagtgcggtgcaaaaagcggaagaattaggcgtgagtattgctgaacaattattacagcaaggtgcagataaaatcttacaggctgtttatcaatcataattgagtaagaggcaatggcagttttaattacacgacccggtgagcgaggagagcgacttgttgagatgcttaataaagctggaattatggcactccatttaccgcttatttccattatagcggggcaagaattaaatcgattacccgataaattacaacaattaaattgcggtgattatgtagttgcagtatctaaaaatgcggtggaatatgcacaaaaaaccttaagtgcggtaggtttttgttggcgttcggacttatattactttacggttggacaacgaactgcagaatattttgcgagccaaatagaaaattcggtgtattatcctgttgagcaagaaagtagtgaaggattacttaatttacctcaaatgcaagaccttcaggcaaggaatattttgattttgagagcgaatggaggacgggaattttttactgagcaggctattttgcgaggagctaaagttgaaactttggaatgttatcaacgaatgcccattgaatataataagttggaaaaaattagtttatgccaacgtattggggtagataccattgttgtaacaagtcaagagatgttaaattacttagtgaaacttgtgccaaccaatgaaacaggctggttattcagttgtcgtttagtaacggtaagtcaacgtatagcggcatttgcaaaaagtgttgggtggacaaatattgttgtggcagataaagcggataacttgagtcttttccttgcattgcaacaatgaaggctggaatttcatttgattaaggaataaaaattatgacgaagaaacattcaaaggttagcacagaaaaacaggataatatatccgtgcaaaatcctcctttggaggcagaattgcaatatgaggaagtaccggctgaggatattgtaaagcaagaaagtaaggctaaacaggaaactttttcaaatcaggagcattttatggaaagagagaatgaacaagttggcgaaaaaagaacagcagctcaagttgaaactgtagtggtgaaaaaaggagggacagtcattgctctattagctttgcttattgcattgggtattgggggagctggctattattttggtcaacaaaaagtagaagaaattcagcaaaagttgaccgcacttagccaaccgtcggaagctgtgccgctagaaaacaatgatactttgttggcaacagttgaagaatataagcaaactgttatacagaagattgagcgactggaaaatgaaatgacaaaacaaaaccagcttattcaaagtttacaagcacaagtaaataaattggatgcggttggtaaagttgaacaatcgacggattggttgttgtttgaaacagattatttgttgaataatgctttacgtaaaatcgtattggataatgatgtggagacagctattgcgttattgaaagtagcggatgaaacactcgttaaggttaatgatcctaaagtcattaacattcgtcaggcaattaatgcagatttaaaacagttattatcagtaaataatgtagatcaaaatgccatcatgcaacatttatctcaattagcaaacggtattgatgaattagttgtattaaatgtgaatttcgatgagcaagaaaatactcaattaagcgattccttacaggattggaaagaaaacgtagaaaaaagtgcggtatcttttttaaatcattttattcgtgtaaaacctcgccatgtgaactcaaaggaattacttgcaccaaatcaagatatttatttacgtgaaaatattcgtttacgtttgcaaattgcgattatggcagtacctcgtcagcaaaatgatttatataaacaatcacttgaaattgtaggttcttggataagaagctattttgatacaagcactgaagtggcacaaaacttcttgaaagagattgatgaacttgctgagaaatctatctatgttgatgttcctaaccaattaaaaagtttgcttttgttggataagttattgaataaggaacagtcatctgtacaaaaaattgaaatgacagtagataaagacttggttagctcaacagatcaagtatctgaggaagggaaaacagatcaagctgttgaaaaatctgatgaaaagccaattgaacagcctgttgagcaagcacagtaataggagaatagcgtatgttcagagttctatttttaatgctggttttattggctggattaattggcggtccctatttatcaggtaaacagggatatgtgttaattcaaacggcaagctataacatcgaaatgtcaatcacgatgttggttattttctttgtgattttaatggccattgtttatctaattgaatgggtggttacacgtttcttccgtttgagtaataatacctatagttggttctctcgtcgtaaacgtgttaaggcacaacgtcaaactttggaaggtttagtgaagatgaatgagggcgattatttcaaagctgagaaattgattggaaaaaatgctagacattcagataaaccaatattgaatttaattaaagcggcggaagcggcacaacagcgaggcgatgattttgttgccaatcgctatttaattgaagcaacagaattagcaggtacagacagtttaattgtcgaaattgcacgtactagaattttattgcaacaaaataaacttccggcagctcgtagttcggtggatagtttactggagatgacttctcgtaataaagaagtattaaagctggcagtgaaaatttacctgaaatctgccgccttccacgcattggataaaattctagatcaaattgaaaaagttggattgtattcttccgatgaattcaccgcacttcaacgtaaagtcgaagatggtttattagacgagaaaatgaacgaagagggtgttgatgggttattacgttggtgggatgaacagcctcgtaaacgccgtaatgatttatatgttaaggttggtttaattcgtcgtttactggacagtgatgatcatgaaagtgcttatgagttagctattgatgctctgaaaaaagttgaaaatagtgttgaagctaatgttgctctttgtactcaaattactcgtttacaaccggaagataacagtaagttattaaaacttttggaaaaacgtgcaaaacagtcaaacagtaaagattgttgctgtgttgaacgtgcgttaggttacctttatgtgcgtaatgatgatttcgctaaagcggcagaagcattcaagaaagtgatagagaataaagcgagcttacaagcaaatgatattactatggcggcttatgttttcgaacaggttggagagcttgaattagcacaaaaagttcgtgaggaaggattgagaaatgcgatgtcaattaaagagccggaaaataaaaccaaaaaaacagcagaaaatccgaccgcccttttagaacaaaaatcctaagtatattgttaaaaaagcccttaaaaatcattgttaagggcatttttataggttttatttttcctcaatgaaagttaaggctttttcaataacctccacaccggcatgagatttatggatgttttcactcatatagcgtcgccattgccttgcccctttacattgttgaaatgcacctaataaatggcgagcaatatgattaagataaacgccttgactcaattgttgctctatgtaaggaaacatattttctattgcttgtcttggcgtgataattgcacaagacggatcaaataacgcttgatcaatatagcccaataaagacgggttttgataagcttcacgcccaaccattactccgtccacataattgagatgttgttgaatttcttcaagcgttttaattccgccattaatgctgatcaataaatgaggaaaatcctttttcaactggtaaactcgctcataattaagtggcggaatttcacgattttcttttggacttaaccctgatagccatgcttttctagcatgaataataaattcttggcaaccgatattatgtactttttcgataaaatcacatagaaattcatagctatcaaactcatcaataccaagacgagtttttactgtgactggaatattgaccgcactttgcattgcgttcacacattctgctactagagcagcccttgccatcaggcaagcaccgaacatcccattttgcacccgatcggatggacaacctacattcaagtttatttcttgatagccacgttcttccccttttttcgcacaatattgtagtttttcaggatcacttccgccgagttgtaatgccacggggttttccgatacatcataagcaagatgatcgtatttggcatgaataattgcaccggtagtaaccatttctgtatagagtaaggtataccggctgaactgccgatggaaaaaacggcagtggcgtgtagtccagtccagcataggagcaacggaaaaacgacctcgataaaagtgcggttgattttgcttcattttttacttgtttgataattgaaacggttagggtttagcgttttcgtgagcttttctctttttgtgcatgccgacggaaacgcccacgcctaaatgataaagtaatacaggattaatttggcgtgaaacaaaagccgttacaatacaatcaatgaatgcttaaatcaagccgatttgatgagttgttattattggtttaaggattgcgtacttaccactcaatatctgagctaatacggtatgtctaagagggaataatcgggttattgcttagatttgatatgaaaggtaatttcatgaggtgaagaaattccggtagattttagtcacttgactggaaaagtgaagtagcaacgtaaagaaaaattggtacactctttttaagtttacgttgctgtcgttttagatatttatttaatcccaggagctttccaaagcgaaatggttagtcctctgtcaaccaatttcagttgctgctggtatatttcttgccatttttctttatgtatttgatataaattatgatttcttgcatttggttgatgttgtctttcaaattttactaatgttttacctgcttcatgtaatgaagtataaataccagcacctactccagctgcaatggcacatcctagagcagttgcttcttttactacaggtacattaacaaccaatcctgttacatcagctagaatttggctccataatttcccttttgcaccacctccggcaaaaacaatactggtaagattaacgtggctgaattgctggacttgatcaagattacatgaagatacaattgctgcattttcttgtaatgccctaaacaggactgatttgttgcatttttcaggatcaatcgaaaggttaataaatgatggggctgcgtgataccaagatttgaaatgcatagcatcagagaatacaggaataacatcatttgaacctacgggtatcttttctgccatttgttccagtaatgtgtaagcatcaacacctaagcgatgagcgacggctttttcttcttcacagaaagcatctctaaaccaacgcatagtaagtcctgtaaagaagctgatagattctgcttgtaccatcggtgcaatgacatgcggattgatgcgtatattcattttaggatctgtcattgcttgtggtaagtttatgacctgttgccagaaagttcctccaataatagcagcttgccccggttctgtaatccctagtccgatacaacctaattgcacatcaccaccaccaacaacaataggcgtgccgactattaacccggtttgctgtgcagaatgggcggttacttgaccgagtatttcacctgtctcttttactttcggtaaaatagcaggattgagtccagccatctctagtaaagtgtgctcccattttcgggtttttaggttgagaatgccggttgtgccagcatttgaaggttcgacggccagttctccgctaagcataaatcctaaccaatcgctaatcatagagagaaaatggacttgagcataaagattaggttgatgatgtgcaagccaaagtaaacggggtaatgcacttaatgccaatgtttgaccagaggattgataaacttgttgttcaaactgatactggtttagagactttaattgaataacttcttctacagatctggcatccacattaccgcacgcccaaatcgggtttttattggcatcgtataaaacaatgccttcacgcatggagcaagtcgatatagctataatttgtttagcatctatttggctggtagctaaaacttcttgaatacataagcaagcaaggtgccagttattttgtaaatcaaagcccattgagcctgggatatttgggtcggaaatatgtgtccattctttttgtgacgtagcgatttgatttccttcaagatcaaaaataactgcacgaatactacctgtgccggcatctaatgccattaaataacgggataattgcattatgttttcctccgattatctgaggaaaatcgttacactactttagctaaaatagtgcgtgcggttttttcctctgtgactaatgaattgatatgctgtcctaaaagtgcggcaataattgcttcaactttatcttcaccaccggcaacgccaataatagtcggtattcgcttgatactatctaatgaaacgctgattaattcctcgtgaatcggcatatccggttgaatgtttccattttcttgcaagaaatagcctaaaatatcccccacagcacctttttgacgaaattcatctagttgtttttcattgatgatataacctgtttgaagcaaagtggagcgtgttttctgaaccgtagatccgataccaacgatggcaacatcagccatactggctgctaacataatatctcgtacatacccctctttttggaaaagttgtgcagcttcaggtgaagaagctcgtagaggggcgggaataatactgatagcacagctactatcaagttgcccaatactttgcatataaggtccaacaccgccggttaaggtgattaacttaatctggttttgtttaataaaatcattgcagtgctttaccgtgtgcatcacggtgtcaccaaacccaaaagagagaacttgctttgctttgagtaatcccatcaacatttgagaggctccgacacctaagcgggcattgacttcataattctgtaactctggcaacacacgaatatgctgtaaatgaaaccgctgttttaaagcttcttctagttccaagcatcctttataacgagagttgatttgaactttgattaagccgatttgtcgccctttttccagtaagcgtgaaacttttaaacggggcaagcccaatttctcaccaatttcattttgtgtcagattatcgtggtagtagaaccatgcaatgcgtgctaataactcttcctcgttaaagccagcttcgtagtgattatctaaatttatcatttttttaccctgtttttattattcatctgattttaattttaatcaaatgttctttttctaaagtgtgaattcgatcacattttacatttaatgtgaaaaaaagacataaaattcttaaaaatgtgaagtttatcacaaaaaaatagaattttttgggttatgatttggaacaaatgataatttaaattttcatttgttcaatttgaaggggcaaaaatgaaagagacagaatctaatcctacgcctttactggaagcttgtgatgtaagtaaagctttctctggtgttgaagtactaaaatccattaacttttccctttattctgggcaggtgcatactctacttggtggaaacggtgctggcaaatcaaccttgatgaaaattattgccggtattcagctgcaagatactggtacgttaaaaattcatggcaaagtccgaaccaatttaacaccaagcaaggcacatcaattaggtatttaccttgttccgcaagaacctttgttattttctaatttgagtgtaaaagagaatattttattcggtttgccaagaacaatggatttacagtcaaagctcacagcgttgttgacggaactaaactcacatttaaatttggatatgcaggctggtttattagatgttgctgatcagcagttagttgaaattatgcgaggcttaatgcgagatgctcagattctgattttagatgaacctaccgcctcattaacaccagtggaaaccgaaaatctattcggacagataaattccttactcatcaaaggggtagggattgtttttatttcgcataaattgtctgaagtttggcaaattgctgattgggtgagtgtaatgcgagatggttacattgccttaagcgagccaattgacaagatcaatcacgacgatgttattcaggcgattactcctcgagctaaaaatgcatcattaacagaaagtcagcagttgtggttggatttaccagggcataagagggtgaaatcgaccgaatttccattattgacagtagaaaatttcactggtgaaggattccgagatatcaactttgaaatttatcctggcgagattttaggattagcaggcgtagtcggctcaggtagaaccgaattagctgaaacgctgtatggtttgcgtaaagccaaatccggtaaagtgatattttgtgatgagctaattaattcactgtccgttaagcaacggcttaaacgaggcttagtgtatttgcccgaagataggcaagcctctggattgcatttggattcaccattaagttggaatacctgcggattaacctatcatgatatgggcttttggattgatgagtccaaggagaaagcaattttagaacgctattaccatgctatcggaataaaatttaatcatgttgagcaatcggtacgtaccttatcaggtggtaatcagcaaaaaattttgatcgcaaaatgtctggaagccgatcctcggttgttgattgttgatgagccaactcgtggcgttgatattggtgcgagagcagatatttatcaattaataaaaagtattgccaaacaaaatgtagccgtgttgttcatttcatctgacttggaggaaatagaacaaatgtctagtagagttttggtaatgcacgacggtaagcttagtcaatcgttgaaaggtgaagatatcaatactgataatattatgcgactggcattcagtagttaggaggcattatgtggaaatttattcagaacaatcgtgaattaactattttagctgccattttgttgttatttggattgctaggtgtggcggatgactttagcttacaaactctcatgatgatttttaactcgacccaaatattagctttgttagctattggtgcgacctttgtgattttaactcgtaatattgatgtctctgtcggctcaattatgggattaagtgcagtagttgttggattagtgctaaattcaggttattccctactgattgcgtgcactattactttactgtgcgggattattgcaggtggggtaaacggtgtattagtctcagtacttagaataccggctattgtggcgacattgggaacattgggtttatataaaggcttaatgttagtattaactggtggtaagtggattgaaggtttgccacattcattgaaaacattgtcagaagaaattgtattggggttttcgcctattgggttagctgttattttccttattttagtcacgtactacttttttactcacacttatattggtcgttgtttttatgcagtgggggataatttacaaggtgccttgcaattaggtgtaaaggtgaatgttattcgcattagtgcatttgcagtaaacggtctaatggctgctttagctggaattatttttgcttctcaaatcggttttgtgccaaattcaactggtaatgggctggaaatgaaagcaattgcggcttgtgtattaggtggaataagtttactgggtggtgcaggtaatattattggtgctgtattagtggcatatttcctgattcaaattgatacgattttagtactgatgaaagtgcctgcctattggaataactttgttgctggtgtggttctattagctgtattggtatttgacggtagaatccgagtaatgattgtcaataatatcaaacaacagcgttatgcccgttttcttaaagataattcattgcaggagaatcaaaaatgattaagaaatacagctgggaaatagctctcttttgtctactgatactggaaattatcgggttcggtttggttaatcctcggttattggatctcaatgtcttatttaacagcaccagcgattttatttatatcggaatgttagcattgcctctaacactgattatagtcagtggagggatggatatttcatttggatctgtagtgggactatgtgccattactctcggcgtattatttagactaggaataccgttaagtgtagcaattgcggtgacatttgcagtcggatcattgtgtggtgcgattaatgctgtactcattatctatactcaagttaacccgctggttattacgcttggcacaatgtatctgtttggtggtggtgcattgttattatcaggttttgctggtgcaacgggctatgagggtattggtggatttcccgatgtgttacttgattttgcaaatctcagttttggtattattccaacaccgattatttatttcttaataatgacattactgttttggttgttgatgcatcgtactcgtattggtcgtagcacatttttaattgggcaaaatttacgggtctctaagtatagtgctgtaccggttaatcaaactctatttattatttatccgttaattggtttgattgcggcttttgtcggtgtgttgctggtatcctactttggttcagctcgttcggacttagggagttcgttgttaatgccggcactaaccgcagttgtacttggcggtgcgaatatttacggtggttcaggttcagtgattggtacagcaatagctgcattattgattggctacttacaacaagggttgcagatggttggaatttcgaatgaaacatccagtgccttttccggagcattgttgattattgtacttatcgggaaatcgcttaatacacatcgggcagtagtgattcaatggtggaatcgaatccgagcagtttaaaataagcggttagtttatgatgatttttgtcaaaattgactgcgataaaacccctgcatacttgttgttttggtatgttttttaatcatacactcaattgaggagacgttctatgaaatactcacttttaaaaacaaccgctcttgccgtagcgttaggttttaccggttttaacatagcacaggctatggataaggtggcatttatcccaaaattagttggcgttggtttttttaccagtggtgggcaaggtgcggtcgaaatgggaaaaaaattaggtttggatgtaacctatgacggtccggcagaaccgagcgtatcgaaccaagttcagatgatcaataactttgtgaaccagggttataatgccattatcgtctcagcggtatcgcctgatggattgtgctctaccttaaaaagagcgatgaaaaaaggtgtaaaagtattaacttgggactccgatactcagcctgagtgccgaagctactatataaatcaaggaacacctactcaacttggctcaatgctagttgaaatggtatcaagtcaaatttctaaaccaaaagcaaaagttgcatttttctattccagtccaacagtgactgaccaaaaccagtgggttaaagaggcaaaagcaaaaattgaaaaagaacatcccaaatgggaaattgtgacgacacaatttggctacaacgatgcaattaaatcgctgcaaactgccgaggggatcttaaaagcctatcctgatttagatgcgattattgctccagatgccaatgctttgccggctgccgctcaagcagttgagaaccttaaacgacaaggtacaatcgttgtcggattcagtacgccgaatgtaatgcgtccttacgtaaaacgaggcacagtaaatcagtttggtttatgggatgttgtgaagcaaggtcaactctctgttgcagtagctaatgaattgttaaaaggcaattctcttaaggttggcgataaattgaatgttgatggtattggtgaagtagaagtatcagcaaataaagtacaaggctatgagtttgaagcaaagggaaacggtattgtgttactacctgagcgtgttgtattcactaaagataatattgataactatgatttctaattatataggagacaatctatggcagatttagatgatattaaagatggtaaagattttggtattggtattcctcaaactaacaagctttttttcgtcaaaggttccagtgcattagattggggaatgcaatcacgtcttgccaatatctttaatccaaaaacaggtaagacaattatgttagcctttgatcacggctatttccaaggtccgacgacgggtcttgagcgcattgacctcaatattgcaccgctctttgattataccgatgtattgatgtgtacccgtggtattttaagaagcgttgtaccgccggatacccgaaaatctattgctttaagagcatctggtgcaaattctattttgacagaactttctaacgaagcagttgcagttagtattgaggatgctttgagattaaatgtatccgccatggctgcacaggtttatatcggttctgaatatgaacatcaatcgattaaaaatattattcaattggtcgatcagggtaatcgctatggaatgcctgtgatggcagtaactggtgtagggaaggatatggctcgtgatcaacgctacttctcactttcgactcgtattgccgcagaaatgggggctcacattattaaaacttactatgttgataggggatttgagcgggttacagcaggttgccctgtaccgattgtaattgccggaggtaaaaaattaccggaattggatgctcttgaaatgtgctatcaagcgattgatcaaggtgcagctggtgtggatatgggcagaaacatttttcaatctgaagcaccaattgcgatgatcaaggcggtgcaagcggttgttcacggtggagaaaatgcaaaagatgcctaccaactctatttaagtgagaaaaacaactaagttaattaggttggctaagttagccaacctatttttcccatgttttctatgataaggagaagcttatgtttgctatgcttgttgaaatcaatataaaagaaggtaaagaaaaagaatttctggaggttttcgaacgtaaccatattggcactcgccaagaactgggaaatttgcgttttgacatattacgagatccggaaatacgaactcgtttttatgcatacgaagtgtatgaaaatgaaacagcactaaattttcatcggcaaactgaacattatcgccgttgtgtaagagaattagaatctttaatgactggttcaagaagtaagaaaatctttgaatggatattaccgaatccttatgtctaaattatcacttattcagcagttaaagcagcaaaaactgagtgttggtatcttatctgcaaattggcttcaacttaatgaagaggtaacaacattgttggagaagcagattaatgtactgcacttcgatattgctgatgggcaatttagttcgttatttacagttggagcaataggaattaaatattttccaacacattgttttaaagatgtgcatttaatggtaagaaatcagttggaagtagcaaaagctgttgtagcaaatggtgcaaatttagtgacattgcagttagagcaatatcatgattttgctttaacgatagaatggcttgctaaacagaaaacaacttatgccaatcaggtatatcctgtattaattggagcctgcttatgtccggaaacgccgatttctgaattggaaccttatttggatcaaattgatgtaattcaattattaactttagatccgagaaacggaacaaaatacccttccgagttgattttagatcgtgtaatacaggtagaaaagcgattgggtaatcgacgtgtggaaaaattaatcaatatagacggctcaatgacgctggaacttgcaaaatatttcaagcaaggaactcatcaaattgattggattgtttctggttctgcgttgtttagtggagaattaaaaacaaatttaaaagtatggaagtccagtattatgtgacatcaataaaaagtgcggtgattatttcgtgatttttataaaataacttgctttttttgagatcatgagtataatctcaccactttcgatatgaaagtcgtttgatgtaatcatttattgaacgtactattacggtatgtaatagataaaatgtccccaatttggaggactaagtaggttcgctgcacttccctttatttaagatgttaaaggtgatggtgtcagtttttttatagctaattttattggagctctggtctaatgcagaaccaaagaatccgtatccgcttaaaagcttttgatcatcgtttaattgatcaatctacagcggagatcgtagaaacagctaaacgtactggtgcacaagtccgtgggccaattcctttgccaactcgcaaagaacgtttcacagtattgatttctccacatgtaaataaagatgcacgtgatcaatatgaaattcgcacacataaacgtttagtcgatattgtagagccaacagaaaaaactgttgatgcattaatgcgtttagatttggctgccggcgttgacgtgcagatcagcctaggttaattaagaggttattacaatgattggtttagtcggtcgtaaagttggtatgactcgtatcttcaatgaagatggggtgtcaattccagttaccgtaatcgaaattgaagccaaccgtgtgactcaagttaaaactcttgaaaacgatggctatactgcagttcaggttactactggttttaaaaaagcaagtcgtgtaaccaagcctgaagcaggtcatttcgtgaaagcaggtgttgaagctggtcgcggtttatgggaatttcgtactgagggtgaagaattcactttaggtcaagaaatcaatgttgacatctttacagatgttaaaaaagtagatgttactgggacatcaaaaggtaaaggtttccaaggtggtgttaaacgttggaatttccgtactcaagatgcaactcatggtaactctttatcacatcgtgtgcttggttctattggtcaaaaccaaactccaggtcgtgtgtttaaaggtaaaaaaatggctggacatttaggtgctgaacgcgttactgttcaatcacttgaaattgttcgtgttgatgttgaacgtaaattattattggtgaaagggtctgtacctggtgcaactaatagtgatgttatcgttaaaccagcagttaaagcataagtctaggagatagagatggaattacaagttgtaggtgcaaacgcactcactgtttctgaaactaccttcggacgtgagtttaacgaagcgttaatccaccaagtggttgttgcttatgcagcaggtgctcgtcagggttctcgtgcacaaaaaacgcgtgctgaagtgtctggttcaggtaaaaagccttggcgtcaaaaaggtactggtcgtgctcgttcaggcgacattaaatcgccaatttggcgttcaggtggtgtgacctttgcagctaaaccacaagatcatagccaaaaagtaaacaagaaaatgtatcgtggcgcaatcaaaagtattctttctgaattagttcgtcaagatcgtttagtggttgttgaaaaatttgagatcgatgtaccaaaaactaaggttttagtacaaaaattaaaagatatggcgttaactgacgcgcttatcatcactgcaagtttagatgaaaatctatttttggcagcacgtaatctttacaaagtagatgtgcgtgatgtgcaagctattgatccggttagcttaatcgcattcgataaagttgttgtaactgtagatgcggtaaaacaaattgaggagatgttcgcatgattcaacaagaacgtttgttaaaagtgttgagagcccctcacgtatcagaaaaagcaacaaataatactgaaaaatcaaatacaattgttttcaaagttgctttagatgcaaataaagtcgaaattgcaaatgctgttgagcaattgtttgaagtgaaagtagactcagttcgtacagtggttgttaaaggtaaaactaaacgtcgcggtgctaaaatgggtcagcgtagtgactggaaaaaggcttatgttactcttcaagaaggtcaatcgcttgacttcgttgaaggtgcggctgagtaatttcggaggagaaaaaataaatggctatcgttaaatgtaagccgacctccgctggtcgtcgtcacgttgttaaaatcgtaaaccctgaattacataagggcaagccttacgcaccgttattaggtactaaatctaaaactggcggtcgtaataatttaggacgtatcactactcgtcatattggtggtggtcataaacaacattaccgtgtaatcgatttcaaacgtaacaagttagatatcccagcggttgttgagcgtcttgaatatgatccaaatcgttctgcaaacattgctttggtgctttacaaagatggtgaacgtcgctatattttggcacctaaaggtttatcagcaggcgatcaaatccaatcaggtattaatgcaccaattaaaattggtaactcgttaccgatgcgtaatattccggttggttcaacagtacataacgttgagttaaaaccaggcaaaggcggacaaattgctcgttctgctggtgcttatgtacaaattatcgctcgtgaaggtaattatgtgactttacgtcttcgttcaggcgagatgcgtaaagtattatctgaatgtgtagctactattggcgaagttggtaattcagagcatatgcttcgcgtacttggtaaagctggtgctaaccgttggagaggtgttcgtccaacagttcgtggtacagcaatgaacccagtagatcaccctcatggtggtggtgaaggtcgtaacttcggtaagcatcctgttacaccttggggtgttcaaaccaaaggtaagaaaactcgtcacaacaaacgtaccgataaatatatcgtacgtcgtcgtggcaaataatattaattaaattaagaggatatgccatgccacgttctctcaagaagggtcctttccttgacctacacttgttgaagaaggtagagaaggcggtggaaagcggggataaaaaaccaattaaaacttggtcccgtcgttcaatgatcattccttcaatgatcggattgaccatcgcagtccataatggtcgtcagcacgttcctgtttatgtttctgatgaaatgatcggtcataaattaggtgaatttgcaccgactcgtacataccgcggtcacgctgcggataagaaagctaagaagtaaggggtaagagatggaaactattgctaaacatcgttacgctcgcacttcagtgcaaaaagctcgcttagttgcggacttagtccgtggtaagaaagttgcacaagccttagaaattcttactttcactaacaaaaaagcggcagctttggtgaaaaaggtgcttgaatctgcaattgctaatgcagagcataatgatggtgcagatattgacgatcttaaagttgcgaagatttttgttgatgaaggtccaagcatgaaacgtgttatgccacgtgctaaaggtcgtgcagatcgtattttaaaacgtacaagccacattacagtggttgtgtcagatcgataatagtagaggaataacaatgggtcaaaaagtacatccacatggtattcgcctaggtattgttaagccttggaactctacttggtttgcgaatacacaagatttcgctgataatttagacggtgatttcaaagtacgtcaattcttgaataaagaattagcgaatgcttcagtttcacgcattactattgagcgtccggcgaaaagcattcgtgtaacaattcacacagctcgtccaggtatcgtaattggtaaaaaaggcgaagatgttgaaaaattacgtaacgcagtagctgctattgcaggcgttccggctcaaatcaacattgctgaagtgaaaaaacctgaattagatgcaaaattagttgcaggtagcattgcttcacaacttgaacgtcgagtaatgttccgtcgtgctatgaaaaaagcagtacaaaacgcaatgcgtttaggtgctaaaggcatcaaagttgaagtaagtggtcgtctaggtggcgcagaaattgcacgttctgaatggtatcgcgaaggtcgtgtaccactacatacattacgtgcggacatcgattataacacctcagaagctcatactacatacggcgtaattggcgttaaagtatggatcttcaaaggtgaaattcttggtggaatggctgcaattgcacaacaaccggaacaacaaccagccacgcctaaaaaggctccacgtggtaaaggtcgtaagtaaggagatttgctaaatgttgcaaccaaaacgtacaaaatttcgtaaagtccacaaaggtcgtaaccgtggtattgctgctggtacagaagttagtttcggtacctttggtttaaaagcagttggtcgtggtcgtttgacagcacgtcaaattgaagccgcacgccgagcgatgactcgtgcggttaaacgtcaaggtaaaatctggattcgtgtattcccagataaaccaattactgaaaaaccattagaagtccgtatgggtaaaggtaaaggtaacgttgagtactgggtagctttaatccagccgggtaaagtaatgtatgaaatggatggtgtatctgaagaagttgctcgtcatgcgtttgcattggcagcggcaaaacttccaattaagacaacattcgtaactaaaacggtgatgtaatgaaagctcaagaactacgtacaaaaactgttgaagagctgaatgctgaattggttaacttgttaggtgagcaattcaaattgcgtatgcaagcagccaccggtcagcttcaacaaacccatcagttaaaacaagtgcgtcgcagtattgcacaagtaaaaactgtattaaccgaaaaggcgggcgcataatgactgataaaattcgtacagtacagggtaaagtgattagtgacaaaatggataagtcatttgtggttgctatcgaacgtacagttaaacatccgatttatggtaagtttatccgtcgcactactaaactgcacgtacatgatgaacataacgaagcaaaattgggtgatgtagttgaagttagagggtgtcgtccactctccaaaactaaatcgcacactttagttcgtgttgttgagaaagcacaggcttaattgacaacgtatataagtaagaacctagcagaaatgctaggtttttggtttttttgatttatagaaatttttaaaattttactgctgataagcatgatatttaatataaattataactatattttaaaaatgattattgttttttagttttgtaagaaaatctgattctaaccttaaaattatttaaggataaaaaatgaaactatataaatttagaaaagaattatttgtattgactcttttagtctccggcagcagtatctcagcagagatcattgcggaattagatgaagttgtcgtatctgatagtagcagtgtagctgattttcaatcactcgcttttcaaggtggtcgtaaagctagtgatgtatttattgagggtaaagagtttaaaacacgttctgccaccttgggtaatgctttagctggagaattgggcgtgcattctaacccctttggaggcggagcaagtgctcctgtgattagagggcaagaaggggtgcgtattaagcttttgcaaaatgggtcggatattgtcgatatgtctaatatttcgcctgaccatgctgtagtcgctgatacacttttagcacagcaggtcgaattggtgcgagggacatctaccttaatgtatggtatggcatcacctgctggtgtagtgaatattgtcgataaccgtattccgacttctcgtcctgagaaagggtatgagggagagatcgtttcacgttttgatacagcgagtaaagaaaaagtcttgaccgcaggggttaccttagcagcaggcgataatttcctgattcgtgctgaggggctgacacgcaaatcagagaattaccatgtgccagaggtatttattggtcaaaaattaaactacctaccggatagtcatcataaatcaaaagtaggaacgctaggcacaacttggataggcgataaaggctatttaggcgcctccgtaagttatcgtaaagaccattacggtattcctgggcataatcatgcgtttgattattgttcagggcatttgtttgatacagataatttgaaagccattacagggggggatggtgaggcaccttatcttaatgcttacccacatttgatgacagatgctgatatgatttcttctctacatttccattgtggtgcggatatccaagggcataagcatagccatgaaagtatttatggacatgatcatgatattagtgaagcaggtcctgtcgtggatatgcgttctaagcgttatgatgtaagaggagagtggaaatcacctattccagggattagcaaagtaaaactctcgcttgcttatgcagactattatcacgatgaaaagcatgatggcaaggcacatattgataagaatgattcgcagggcataaaagatagaaagaaatatacggctgccattatgtcaggaaaaccagaagctttttatgctaatcgtggatttaatagccgtttagagatttatcatcaacctacagagcattttaatggtgtagtagggatgcagtatcaaacacaaaaaactaaagttcagcgtttagcgcctagtttaaataataatggacaagatttaagtggtgagagaaaagagtctgaacgtaatccattggtaccgcacacgaataagcaattcagtgtatttgcattagagcaatttacttggcgtaattttattgttgaagtgggggcaagatgggagaaacaacgcattccaatcaaatatgatccgcataaattacgtcttgataaagctgcaggttctaaagttcgtctaccagatttatctccttatactgaaaatgctttgtcatattcaggtactctaatgtgggattttcatccagcttatcgactgtctatcactggctcgcataatgaaagaattccatcaccaatggagctgtattatcatggtaaacatcttgcaacaaattcctttcaatatggcaataaggatttaaagaaagagcggtcaaataatgtagaaatcggtctgatgcgtatttccgacaaatgggattttaaagtcagtgcttattaccaacgctttaagaattatattcacaatgagaatttgtatcgcgagggtaacttatttatgcgtcgctataaccaatctcaggcaaggttctatggttttgagggcgaaatcggttatcagataacgcctaatcataaaattacgttctttggcgattatgtcaatggtaaactctttggttttaaaaaattctatggtaatccgaagtttaaaagggtatgtgaacttgagaatgatggaaaaaataatctcgagaaatgtgttgagaacgaagaatggggggaggaatggagctatcataaaattggagagcaaactatcgaacgtcccaaccgcaatgcagcccgtgttccccctatgcgtttgggatttcgtctaaagagccagtttaacgataattggtctggctcattggaatatacgagaatgtttgtacaaaaacgcatatccattaatagcgtgatcaaagagattgatcgtgaggaagcagagaagcgaagagaaaatgcgaaagggcttgggtatgacggtcattatacagaacttgtccctgaagatgttacccaaggctatcacttactgaatctttctctcaattattcacgtaaaatagatggagtagaatatagtgcgacattaagtgcgaataatttgttgaatcaaaaaatctatattcataactcctatttgccttatgtaccgcaaatgggcagaaattttattttgaatgtcggggtaacattctagttgttcgtgaggatatcaaagagcggttgttttttgcaaaataaccgcagtatgttttctttaacgaaacctgttatctttttccaaaagttacttgataagtgcggtgctattgtgctaaactctgcgacctgtttaccatagggtagatgggttcgtcccgaaagggtgttttttattttaacggagcactaatatgatccaagaacagactatgctggatgttgctgataattcaggggctcgtagcgtaatgtgtatcaaggttctaggtggatcgcaccgtcgttacgctgctatcggtgatatcatcaaagttactgtgaaagaagcaattccacgcggtaaagttaaaaaaggtgatgtgttaaaagcagttgttgtgcgcaccaagaagggtgttcgtcgcccagatggtgcagttattcgtttcgatggtaatgcttgtgtgattttgaacaataacactgagcaaccaatcggtactcgtatttttggaccggtgactcgtgaacttcgttctgagaagtttatgaaaatcatctctttagctccagaagtactataaggagaaaatgtaatggctgcaaaaatccgtcaaaacgatgaagtaattgttcttgcaggtaaagacaagggcaaacgtggtaaggtaactaaagtgttaccaaacggtaaagtttttgttgagggtgttaatattatcactaagcacgaaaaaccagttcctgctttaggtaaagctggtgggttagtgaaaaaggaagcggcaattgatgtatcaaacgttgcaatctttaatccgacaacaaataaagctgaccgtgtaggttttagaattgaagatggtaagaaagtacgcttcttcaaatctaataatgaaattatttaaataactggagtaatgtgatggcgaaactgcatgattactacagagatacggtagtcaatgaattaaaagcaaaattcaactactcatctgtcatgcaagtcccacgaatcgaaaagattaccctgaatatgggagtgggtgaagcattgaccgacaaaaagttgctagataacgcagtagcggatttagcagcaatcagtggtcaaaaacctttagtaactaaggctcgcaaatctgttgcaggctttaaaatccgtcaagggtatccaatcggttgtaaagtaaccctacgtggtgaacgtatgtgggaattctttgaaagattgattactatcgctgttccacgtatccgtgacttccgtggtttaaacaccaagtcatttgatggtcgtggtaattacagcatgggtgttcgtgaacaaatcattttccctgaaatcgactacgataaagtagatcgtgtgcgtggtttagatattactattaccacaacagcgaaaagtgatgaagaaggtcaagcgttattagcggctttcaattttccattccgtaaataaggtaggttatcgtggcaaaacaatcaatgatcgcacgcgatgtaaaacgtgctaaattagctgataaattctacgaaaaacgtgaagaactaaagaaagtcatttctgatgtaaatacatctgatgaagaacgttgggctgcagtgttgaagttacaaacgcttccacgtgattctagtccagttcgtcagcgtaatcgttgccgtcaaactggtcgtcctcacggagttcttcgtaagtttggtttaagccgtattaaggttcgtgaagctgctatgcgtggcgaaataccaggtcttaagaaagcaagttggtaatttaccactttattttggaatcggagtaaaagcacaatgagtatgcaagatccaatcgcagatatgttgactcgtattcgtaacggtcaagctgcgaataaagttgcgattagtatgccttcatccaagctaaaagtggctattgccaatgtattagcggaagaaggttatattgctaacgttaaagtttcggaaggcgttaagcctgaattggaaattacattaaaatatttccaaggaaaaccggttgtagaaagtattcagcgcgtaagccgccctggccttcgtatttacaaacgtaaaaacgaattgccaaaagtgatgggcggattgggtgttgctgttgtatctacatctaaaggtattatgactgaccgtaaagctcgtcaagcgggcttgggcggtgagataatctgttacgtagcttaagaagagaggtaggaaaatgtctcgtgttgcaaaagcacctgttagtattcctgccggcgttgaggtaaaacttgacggtcagctactaacagtaaaaggtaaaaatggtgagttatctcacaccattcataactcagttgaagttaaacaagataataatcaattaacattctctcctcgtgtaggtattgctaatgctgatgcacaatcaggcacagcacgtgcattggtcaatgcgatggttatcggtgttaatgaaggttttactaaaaagttacagttggtgggtgttggttatagagcacaaatgaaaggcaatgtacttgtgctaagtttaggcttttcacatcctattgaccatgtgttaccagctggtgtaactgctgaatgtccatcacaaacagaaattgttctgaagagtgctgacaagcaattgattggtcaggttgcagctgatattcgcgcttatcgccgtcctgagccttacaaaggtaaaggggtacgttatgctgatgaagttgtacgtatgaaagaggccaagaagaaataattaaggtaacactatggataagaaatcagctcgtatccgtcgtgcagctcgtgcacgtcatatgatgagagagcaaggtgtaattcgtttagttattcaccgcacttcgcgtcatatttatgcacaagttattgcaccaaacggttcagaagtgcttgctactgcctctacagttgagaaagcaattagtgagcaagttaaatatactggaaataaagatgcagcggcagtggttggtaaaattgttgctgagcgtgcattagaaaaaggtatcaaaagtgttgcttttgatcgttccggttttaagtatcatggtcgtgtccagtctttagcggatgctgcccgtgaagctggtctacagttctaatagaggtaattttagatggcaagcatcgaaaaacaaactggtgaactgcaagagaagctaatcgcggtaaaccgtgtatcaaaaactgtaaaaggtggtcgtattatgagctttactgctttgacagtagtaggtgatggtaacggtcgagtaggttttggttatggtaaagcgcgcgaagttccggcagctatccaaaaagcgatggaaaaagcacgtcgcaatatgattactgtggctttaaatgaaggcacattacagcatccaattaaaggttctcacactggttctcgcgtatttatgcaaccagcaagtgaaggtacgggtatcatcgctggtggtgctatgcgtgctgtattggaggttgcgggtgttcgtaacgttctttctaaagcatatggttcaaccaacccaattaacgttgttcgtgcaactattgatgcattagcaaatatgaaatcaccagaaatggttgctgccaaacgtggcaaaaccgttgatgaaatcttggggtaattgatgatggcaaaaactattaaagtaacacaagttcgtagttctattgctcgtttaccaaaacacaaagctactttacgtgggctaggtcttcgccgtattaatcatactattgagttaattgatactccggctatacgtggtatgattaaccaagtttcatatatggtcaaagtggaggagtaagagaatgcgtttaaatactctatctccggctgaaggtgctaagcacaatgcgaaacgcctaggtcgtggtattggttctggtttaggtaaaacaagtggtcgtggtcataagggtcagaaagctcgtactggtggcggtgttcgtcgtgggtttgagggtggtcaaatgcctttgtatcgtcgattaccgaaatttggttttacttcaatgaaatcagctgtaacagcagaagtccgtttgaatgacttagccaaagtagaaggtaatattattactttagatacattaaaagcagcgaatgttttaacaaaggatatccggtttgcgaaagtaatccttgctggtgaagttaaaactgcggtaaccattcgtggtttaggtgtaactaaaggtgcaaaagtagctattgaagctgctggcggttcaattgaggaataattaacaaatggctaagcaaccaggttatcaaaatagaagtactcaaagcggtactagtgaactaaaaagcagattattatttgtgctaggtgcactgattgttttccgtattggttccttcattccggttcctggtattgatgcggccgtgctggctcaattacttgaacaacaaaaaggcactatcattgatatgttcaatatgttctctggtggtgcgttgagtcgtgcgtcaatttttgcattaggtatcatgccttatatttcagcatcgattattattcaattattgaccacggttcatcctgctttagcagagttgaagaaagagggagaagcgggaagacgtaaaattagtaagtatacacgttattctactctcgtattagcaactgttcaggcaatcggtatttctactggtctacctaatatgctacctgggttagttcctaatttaggctttggtttctattttacagcggtaattagtcttgtaacaggaaccatgtttctaatgtggttaggtgaacaaattacggagcgtggaataggtaatggcatttctttaattatttttgcaggtattgttgcagggttgccttcagcaattggtcaaactattgagcaagctcgtcaagggcaaatgcatctattagttcttttattgatcgcagtaattgtttttgcggtgacttattttgttgttttctttgaaagaggacaaagaagaattaaagtcgagtatgcaaaacgtcaacaaggtcgtcagatagtaggtggtcattcaactcatctaccattaaaagtaaatatggcaggagttattccggcaatttttgcttcaagtattattctttttcctgccacgttaacatcttggtttggacaaggttctaatttggaatggttaactgaattatcgctattattacatccaggacagcctttatatctgattgtttatgctgtggctattatattttttagtttcttttataccgcaatgcaatataatccgcgtgatacagcagataatttgaaaaagtctggcgcatttatacccggaattagaccaggtgaacaaacatcgcgttatattgataaaattatgactcgccttacattaattggtggattatatattacgtttgtatgtttagttccttatattatgacatcagcttggaatgttcagttttattttggtggaacgtctttgttgattgttgtagttgtaattatggatttcatcgtacagattcaaagtcatttaatgtcaactaaatatgaatctgcgttgaaaaaagcaaaccttaaaggttttggacaataaatgtccatatagtaaaaaggataagtaatgaaagttcgtgcttcagtcaagaaaatgtgtcgtaactgtaaaattgttaaacgtgaaggtgttgttcgtgtattatgtagcgaccctaagcataaacagcgtcaaggttaattgatatttttcttgcaaagaaccagctgggtatatataatactcagctcatttatgtccttgatatgctgtttgagtatcctgaaacgggcttttcaagatcagtatatcaaatttaatcaataaaataataggagtgcatagtggcccgtattgcaggcattaacattcctgatcaaaaacatactgtaatcgctttaactgcaatttacggtatcggtaagactcgagctaaggcaatttgtgcagctgcgggtattgctgaagatgtaaagatcagagaattgtctgaagagcagattgataaactgcgtgacgaagttggtaaatttaccgttgaaggtgacttacgtcgtgaagtaacacttaacattaaacgcctattagatttaggttgctatcgtggtttacgtcatcgtcgtggtttaccagtacgtggtcaacgtactaaaactaatgcgcgtacccgtaagggtccacgtaagccgatcaaaaaatagtcggggtaaggttaaatggctaaaacaccagttcgtgcacgtaaacgtgtaaaaaaacaagttgtagatggcgttgctcatattcacgcatctttcaataatacaatcgttacaattactgaccgtcaagggaatgctctagcatgggcaactgcaggtggttcaggtttccgtggttctcgtaaatctaccccgtttgctgcacaagttgcggcagaacgttgtgccgaagttgtaaaagaattcggtttaaagaacttggaagttatggttaaggggccgggtcctggtcgtgaatcaacaatccgtgctttaaatgcagcgggatttcgtatcacgaatattacagatgtgactccgattccacataacggttgtcgtccaccgaagaaacgtcgtgtttaatgacgtcataggatagttggagaaagaaaatggcaagatatttgggtcctaagctcaagctaagccgccgtgaaggcactgacttattccttaagtctggtgtgcgtgctattgatacaaaatgtaaaattgatacagcacctggtcagcatggtgctcgtaaaccgcgtttgtcagattatggtagtcaattacgtgaaaagcaaaaagttcgccgtatttacggtattttagaacgtcaattccgtaactattataaagaagcaaaccgcttaaaaggtaatactggggagaatttactggtattattggaaggacgattggataacgttgtttatcgcatgggctttgctgcaactcgtgctgaggctcgtcaattagtgagtcataaagcgattgttgtaaatggtcgtgtagttaatatcccatctttccaagtttcagttaatgatgttgttgctgttcgtgaaaaatctaaaaagcaagcacgtattaaagcatcattagaattagcagagcagagagaaaaaccaacttggttggaagtcgaagcagctaaaatggaaggtgtgttcaaacgtgttcctgagcgttctgatttatcagcagacattaacgaacatctgatcgtagagctttactctaaataatagttaaggctttgtagcaaagagaggataaaatgcagggttctgttacagaatttttaaagccacgtttagttgatattgagcaaattagttctactcatgctaaagtgatcttagaaccgttagagcgtggctttggtcatactctaggtaatgcattgcgtcgaattcttctatcttctatgccgggctatgcagttaccgaggtggaaatagatggcgtattgcatgaatatagtagtaaggaaggtgttcaggaggatattattgaggtacttctgaacttaaaaggtctagcggttaaagtacagaataaggataatgtttttctgacactaagcaaatctggaattggccctgttgttgcagctgacattactcatgatggtgatgttgaaatcgtaaatcctgatcatgttatctgtcacttaacagacgaaaatgcgtctattaatatgcgtattcgtgtacaacgtggtagagggtatgtgccggcatcatctagagttcattctttagatgaagaacgtccgattggtcgtttgttagttgatgcttgttatagtccagttgatcgtattgcttataatgtacaagcagcacgtgttgaacaacgaactgacttagataagttggttattgaactggaaacaaatggcacaatcgagccagaggaagcgatccgtcgtgctgcaacgattttagcagagcaactagatgcctttgttgatttgcgagatgttcgtcaaccagaagttaaggaagaaaaaccggagtttgatccgattttattgcgtcctgttgatgacttagagttgacagttcgttctgctaactgtttgaaagcagaaacaattcattatatcggtgatttggtacagcgtactgaagttgagttactgaaaacacctaatttaggtaaaaaatctcttacagagattaaagatgtgcttgtttcacgcggtctatcacttggtatgcgcctcgaaaattggccaccagcaagtattgctgaagactagtttggacataggttaaagatttttctgagaaggataaggtcatgcgtcatcgtaagagtggacgtcaactaaatcgtaatagtagccatcgtcaggcactattccgtaatttagctagtgcattggttagtcacgaaattatcaaaactaccttgcctaaagcaaaagaattacgtcgtgtagttgaaccgttaattacattagcgaaagtagatagtgttgcaaaccgccgtttagcttttgctcgtacacgcaacatcgagacagttgcgaaattatttaatgaattaggtccacgttttgcacaacgtgcgggtggttatactcgtattttgaaatgtggtttccgtgctggtgataatgctccaatggcgtacattgagttagttgatcgtccagccttagctgaagaagctaaaacagagtaatttataactcatttaaaaagcccacagtaaaatgtgggctttttgtagtaatcatatttattttctattctattccctatcatcaattcctatcaataaaaaatttccgtttatattacataaacttctgaatccaacattggtaattttaaaaggatttttatttggacgttttgtgtagtcaaagctctcatggtgatgaccgtgaaaaacatgctttacttgcattgatgtggctaaattattaataacagaaaatcctaaaggatgaggttttggtgcctcatgacatattagtatgtctgctttttgtttttctaatgcttcaatatcagaaggaaagattgaagttctatgacgcaatggaatacctcctcgccaaattttttccggaggagcgtattggcaatagtggatatgatcaaaaaagagcggtttatttggtggcatccaaatttgtccacgaaacacgcctcctaatccggcaatttttattccttgaatgtcgacaactttaccgtgtaaattacgtgatttccattttgtaccccataaggcctcatatgctgaaactgttttgctatcatgatttccatggataaaccaaagatcacaaaactgtgccagtttatccagttcatcagaagtagttaattgtaaatcacctaaaataataagagatacatttgcatgttcttgaataaaagggtaaagatgggaataacttccatgtggatcaccagcaaataaaatcataatattattccttaaaaattgaaggtgtgattgtttccacggctaagtccaaaatttcttcgttgagtactttctcaacaatatttttcacttgattataacgttccaagtaactgggtgagtcaatttcaatataaggtacactatgcttatctaataatttttttaagagttgttggaagcgttgacgttgtttagcatttcctaagctacgcaagccatcatctacccattgggtattattatttaataaaatggtcacatcaaaaggatattctttgatcatggagtctaagaaagggtgtgcttttccttcatactgaatacaaaatgcctgagttgtaataaagtctgtatctacaattgcaactttgtgtgcatgcctgacggcataatcaatataacgctgatgacctaatgctatttgtggataatcagaatattgcatagcttgttcattacctcccagtttttcaaaaacaaattcacgtccatattcccaagctgatgtagtattaaatactgtagctagcttattaacaagagttgttttaccgctactttctccacctaaaatagcaattgtttttgcaaaaaatgggcgaacttctttaggaatgaatttccaatagtgaaatggattgttacgaatttttgttgcagaaatattaaggaatcggcgttttggatcaactaattcgacttgtaaatttaaatatttttcataaggtactttatcttggatttcactgctaaaaaccacgctaggattaacgtttttttccttgaatagacgttttacttgttcagcccatgcagaccagccattgggataacttggtagaccatcttcaataagatgatgaataacaattttatttttctgatatttaaaaatttgttgcatccaacgtaagcgatcctgtacagttggcattcgtttcattttactgtcataaaatagttttaaatctcgttctgtatcgctacatacaaccacatgaagctcatctactttgctaaatgcttcataaatcatattaatatgaccggtatgaacgggataaaatttgccgaaaataacgcctatttttttgttatcttgttcagtaatctgtagtgctttatgcaatgctgaaagttttgtggcacttggatttttaatttttccactcactaattggttaaaataagcacgagtgatattggcttgtgtacaaagctcattaaccttcagatttaattgcttacgtttttgttgcagatagctgaaactcgacattattttctccttttctatttcgggaatatttaatgagtagcataaaaagtgcggtaatcacttagtaagttttttatttttcttgtaattgttctaaacgtttctctagttcaatcagcttttcacgagttcttattaaaacttgtgtttgcacatcaaattcttctcttgtcactatatctagtttagataattgagattgtaagacttgttttagtttcatttcggcatcttgccctaagttttttacaccttgagggagagaatcttgaatttgttgcataatttgttctatttttttaggatttagcataataagctccattttgatataaattgccccattgtatgcaatcttattcaaaataaaaacattttttcttattaaacgttaagatatactatacatgcattctcagggcagggtgaaactccctaccggtggtaaatatttcgatataagcccacgagcgcttacttatcttagtaaggtcagcagatttggtgaaaatccaaagccgacagtgatagtctggatgaaagagaatagagcgaggtattatacttatcgttgttgtttttctatttatctgatagaaaaaatccttttatcatcagccctgattctggtatctattaatttatttaaaggagtttactatgaatcagtcattattatctcagtttggtacatctgaagaacgagttaaacgtgcgattgaagctttcaaaagagggaacggagttcttgtccttgatgacgaagatcgggaaaatgagggtgatcttatttttccggctgaaacaatcacagttgaacagatggcaaaattaattcgttatgggagcggaattgtttgcttatgtatcactgatgaactttgccaacagctcgatttgccaccgatggtacaaaataacacaagtattaatcaaacagcgtttactgtgagtattgaagcggcacaaggtgtatctaccggcgtatctgcacaagatcgcgtaacgactattcaagtcgccattgctgataatgctaagccgcaagaccttagccgtccgggacatgtatttccattaagggctaaaaagggcggtgtgttagcacggcggggacatactgaagccgcagttgatctagcttcttgggcaggtcataagcctgccggggtaatttgtgaaataaccaatgatgatgggagcatggcaagaacactggagatcgtagaatttggcaaaaaatttaattaccctgtggtaacaattgaggatcttgtccgttattcatcaagcaaagttgtttagctcgataagtaagaacatcatcaattttttttcgttgttgatgctgtaattaaattgaaatttccctgttcccaacagtttgggtttctgtaaataaaaataaaatgaagactatgcaagatgaaaaatctgttaaactgtgtgctatttaaaatgggttaaaggataaaattattagtaacttaaaacgtgggtttgtcttacatcgacgggattatagtgaaaccagtttgttggtcgagttattcactgaagaacacggacgtttaacagtattggcgaaaggggctcgtgcaaaacgatcggcgtggaaatctttgctgcaaccctttacacctttgttacttaattggtctggtcgtggggaattaaaaatattaataaaagcagaggcgatatcattaactttaccgctacaaaccaccgcactttatagtggattttatgttaatgaattaattgctcgtctattggctccggaaaccgcatatccggatctttttcaatattatttgcaatgcttaactgcattggcaagctcaccgcaagaaatcgaaaaaagtttacgcacttttgaatttcaactgttggaggttttgggttatgccgtggatttttgtcattgtgctggttcggggaaaccagttgatgaaaagatgacttatcgctatcgagaagaaaaaggctttattgcttctttaattaaggataacctgactttttatggacgtgaattattagcttttgagcgtagagaattcgtcgataagaccgtcttgcaggcggcgaaacgttttagccgtattgctttaaaatattatttgggtaataaacctttaaaaagtcgtgaattatttacgcagaatattttacatacaaaataagttttactagatataaatttatggttttactttatcagccaaagaaacaaaaaaaattgagagcagcttttacgaccattgttcaagatttggattatcaaggattaggtgtagcaaaaattcaaggaaaaacgtggtttattgagaacgcattaccacaagagcaagtacaggttcaagttattgaagaaaaacgtcaatatggactgggtcgagttcaaaagattttacaagccagccctttgcgacaaactccaagatgtgcttattatcaaatttgtggcggctgtcaatctcagcatatccctatacatttacaacgtgaaacgaaacaaaaagcgttatttcagcgtttaaccaaactgcaaaaagaggctatagaatttatgccgatgataagtggcgaagcatggcattatcgccgtagagtacgcttaagtttgtactgggacgctaaaagtaaaaaattgaagataggctttcggcaaaaaaattcacaacaaatcgtgaatattcgtcaatgcgatgtgcttgatcccttgttaaatgagttattacctaaattgcatgagttgttgagtacgtgctctaaaccgaaaacactaggacatattgaattagttgccgcagataatggcgtagcgatgttattgagagtaacagaaaaattggctgaacatgaccgcactttattgttggattttgcatttaatcatcaagtgatgttatttgtacaagatgaaaaagagatttgtcatttgcaaggagatttgccttattaccaattagatgatggttctattttacattttgatattcgtgattttattcaggttaatcgccaacttaaccaaaacatggtcaatactgcactggattggttggatttgaagaagaaggataatgtgttggatttattttgtggtatgggaaattttaccttgccgattagccgatatgtgaaaagtgcggtaggaattgagggtgttttacctatggtcgaaaaagcccgtcgtaatggggaacgaaatcattgtcataatgtccaattctaccagtgcgatttaagtcaatcttttactgagcaagaatgggcaaaggttccttttgacaaaatcttactggatccaccgagaagcggtgccgcatttgctttaaatgcattgtgttatttaatggctgaaaaaatagtgtatgtgtcttgtaatccggcgacattagtgcgtgatgtggagcttttgcttaagtttggttatcaattaaaaaaagttgcaatgattgatatgttcccacatacaagtcatctggaaagtattagcttatttgaaaggaacagataggaagtaaagttatggttgcagtgcgtggttcacatttacttaatttgcaagattttgtggttgagcaatggagtaaaagtttatctttacctgagaatgttgaacaaaaattaatacaggcttggcgttatgcacagcaaaagtgtcttattgtacaaagtgaatcggagaaaaaaattgtttgttctttgcaagctggtgtggaaatggtggaaattctgcatagtttgaatatggatgcggaaagtttgattactgcaatgctttatccattggtgaaccataaaatgacttcccttatgcaaatcaaagaagattttggcagtaatattagcaagttagtgaaaggcgtagtggaaatggataacattcgccaacttaatgccagtcattcagccaacagtttgcaggtggataatgttcgtcgtatgttattagctatggttgatgattttcgttgtgtcatcattaaacttgcggaacgtattagctatttacgggatgtagaccgcttgtattctgaagaagaaaaagtactggctgcaaaagaatgttctaatatttatgcaccgcttgcgaaccgtttgggtattggtcaattgaaatgggaattagaggattattgtttccgcactttacaccccgatacttaccatgcgattgcaaacttattaaaagaacgtcgtttggaccgtgaacaatatatcgcggattttgtgcaggagttacgtggttatctgaatgagaatttggatcaagtagaagtgtatggacgaccaaaacatatttacagtatttggcgtaaaatgcagaaaaaacacttggaatttagtgatttatatgatgtaagagcggtcagaattattgtacaaaaattgcaagactgttattccgctttgggcattgtacatactcatttcaaacatttgcctaaagagtttgatgattatgttgctaacccgaaaccgaacggttatcaatctattcatactgtcgtgttgggcaaaggtggaaagcctattgaagtgcaaattcgtactcaacaaatgcatgatgatgcagaattaggtgttgctgcacattggaaatataaagagggtgtaagtggcggacgttccggttatgaagaaaaaattgcatggttacgcaaattattagcttggcaagatgatattacagattccggtgaagtaatggcggaaatgcgtagtcaagtttttgatgatcgtgtttatgtcttcacgccaaaaggcgaagttgtggatttaccaacaggatctacccccttggattttgcgtatgctattcatagtgaaattgggcatcgttgtattggtgcgaaagttggtgggcgtattgtaccttttacttatcagcttcaaatgggtgatcaaattgagattattactcagaaaaccccgaatccaagccgtgattgggtaaatccgaacttaggttttacgcacacggcgaaagcacgtgctaaaattcagaactggtttaaaaaacaagatcgcgataaaaatattcctgccggaaaagaattgcttgaagttgaaattgcccgtttaggtatttccttaaagcaggtagagcaacacggattgcctcgctataacctgaagaacttagaagacttgtatgccggtattggtggtggagatattcgtctaaatcaacttattaactttttacaaaataaattaattaaggtgagtgcacaacaaacagatgaagaaattttgcgttatgtagccaataaaggtgctcattatgtgagtcaaaaacaaaaaacagagaaaaaaggttacgtgattgttgagggggtaggtaacttaatgtaccatattgcccgttgctgccaacctattccaggtgatgatattatgggctatatcacaatgggaagagggatttctattcaccgtggcgattgtgaacagtttatagagttgcaaaatacacaccctgaacgtgttgttgagtcagtttggggcgaaaattatgccacaggtttccgtatcagtattcgtattatcgccagtgatcgaaacggtttattgcgagatattacaacagtattagctaatgaaaaaattagtgttttgggtgtatcaagtcgtgcagatacgaaaaaacaacttgcgactattaatatggaaattgaattaaataatgtacaaattttaagtaaaattctggcaagattagcgaaattagatgacataattgaggcaaaacgtctttagataagttaggcaaagataaaggtaaagataatgaaaaaaacaaccggattggagcattttataaaatcaatagtctattccttaaaagggttgaaaagcacgattcaacatgaaagtgcttttcgtcatgagcttgtggtttgttgtattttatttcctttagcgtttcattttgcacaaagcaaaattgagtttgtgcttatgattggttctttattattggtgctggttaccgaattgttgaatagtgcaattgaagttgtggttgatcgtattggaacggaatatcatgagttatccggacgagccaaagaccaaggctcagcagcagtttttgtcgccataatccttgcactatttacttggggagtgattttattttgttagcgtgttgacatccgccctgccttcaggcggggcggatgtcaatagactagaaacgaacttccacggaagcggcaaaattgcgttttggtgcggtaaaacgattgatgccttcccctttaagtcctacagaacgagcgttataaccattgttaaaccataagttatagacactatcccaagttatataattacggttgaataagttaaaaatccccatattcaatgtaacatttttactcaggttaacttgtcccgttaaatccactacaaagtaggaaggacttaaatagggccacggtttcacatttttagcaacatcaccacttttgttaccgccaagttcatattttacctctatagcatctttagcttttttagccgcactgtaacgaccggttaaactgatactccatttttccgtttcataatcaattcccccaaccactgtccaaggctgaatagatctgagtggttcgttgtcatgattttgccctttgctataactccctttgaggcggaatgttaacccatctgacagtccgaatgccgagccattaacagcaccgctaacttctatccctttaattaccgctttaggttcattaacaaactgagtttccgtaataaactgtttcgaaccaccccaaaaactactaggattgtagtatggattttgtttaaaattatcacgttcttgaataaaattatggtaacgtgtgcggaaaagcccgacgctaaagtgggcatattgattttggaaacgataacttaattcgtggttcagtgcagtttccggttgcaacaatgggttcggtttaaaattattagtagtaccactaccgtcacttacaaaatataaatcttcaacacgtggtactctaaaaccagtactcaggcggtagccaatttgatgtgatgggtgtacttgatactccaatcctagttgccaagaaagacgagaaagttttcttgaaggaaagttgatgatagcattattgacttgccccttgagttgagggttgtaattgtagcgatcataacgcccgccaatagtggctttcaatgtatcagttaaagcgatttcatcaagcaacgatagggaaaaaatacgagattttactggactaacttccgtataattcgggcgacttttgcctatccaataggaactagtagagaaacgtatagagttgctgttttccaaaaattgatcacgaaattccactttgccggataaacgatgtgtggttcgccataatgctaatggataagttgataattccccgcgagtaatagtttggttttgaatgtactgatgggaagaaagtcgaaataattgattattcctaatagtgagaaaagctgaaagttgtttgatttgttgttttgctacaaagagttttgctgtttctaaccaagagaagccattatatcgatattcgagaccataacggcggtatggtgttctgtctgtggcaaatcggttctcatcactaagccctaatgttttttcttcggtaaatttcttttctgcacgatcttctaaaaatagtgtaaagcgatgggtgttattaatatcgtagccgatttttgttaaccatgaggtggtgtggtagctgaggggatcgggtttaccacgtttataagtggtagtatctgcacctttgccattattgattgtttcatgcccccaacgtttggttaattgtgcaaaaccgaagaagcgatcagtcttgaaccccccccctatcacttgacgccattctctattttttgaggtataaccggttttggataagaagccgaaagtgcggtcaggttcgacaaaatcttcaatctctttggtggtaaaagaaaccgcaccccctaaagcaccactaccattcatgacagaatttgcccctttctgtacttttaccgagctaatattttcatattccgtattattgatattaccattatggagtccagtcgaagaacgtgcggaagtggacattgttgattcggcttgcggtataccatcaacaatcaccgcaacgcgatctttgtcgacaccacgtattgcaaagccgttactaccagaacgaccgccttcaggcacgccaatccccacttcatgacgaaataaatcacgttcattagacaccatatttttccgcaattgttcggaagattgagtagaggaaaaaataggctcaacattcgccacaacggatatttcacccaattcttccgctttatttggctttgttttttcttgattcgaatcggcaagacttaatgcaggaaacatcaagctacttgaaagaaacaattggttgagaataatagaatacttagatttcaaaatgaaaatctccctgtaaaaaatataatagaaatgagaatggttcttataattataaatgccctaactgtcaagttttttaatcatttttatggaaagagtaagttatttgaataaactatattgttgctaaacaaaacgttgcttgtgaaatgtatttttcactagcatttttaccaagagtttttgtattatatgagcaaaataagtatgccttgattcatatagatataaaagagttgttaaatattaatgcgataggatatgttaaaaaaattaattttacttgtcatcccgatgttgctaacggcttgtgcatcttcgttaaaagtgcttgaactgccgcaagtaaaaacagacagcagactttttgtgattacacaacaatttcctcaatcggaaaaaagtttgctggcgattgaagttcaacctcatcaatggcgttgggtgcaaacagatccgctcggtgcacctattgctcgtcttgttttgagtaaagcggggtggcaaaacgacggtttcgttatgccgaataagcaggcaaaacagcttttttctgcgattgcgacgtattttatgtcgactatgattttcgatgtccagcagatctcggaaaatgaatatgcacaaaaccatcggttaatatggcgattttctccgcaaaaacacggcgttaatattgagttgggggataagtctgtttggtttgtcgaacctttgagactgaattaaaattgtactaattatcagaaaataaaatgacggaaaccttatatttatcaaaacctgcgataatcagtgctatgggcgaagggctgaaaacgcatatagaaatgttattgaatgcggagcattccccgttagtgcattccgataaggtgtttagtcggcatcacattgccggtaaaatcggtgtcttcggcgagataaatttatcattacgcccatttccggaaaagcttagtgtacaacaccgtagtcgtaataatcaggtattgtggcacgcattggcagatattgaaccgcaaattgagcaagctgttcagcagtttggcaagcaacgtatcgctgtggttattggtagttcaacaacgggtgtagatgaaaatattcctgttttcaaaggtggagcaagccaacaagattggtcgttagcacctttcaattttcagcaagtttcattttccgctccagcagattttgtggcggaagtttatggtttaagcggtttagtctatggtatttctactgcctgtacttcgggtgcaagagcgttaatcagtgcggctcggttattgaaaaataatttgtgtgatgcggtaatttgtggtggtgtagatacgctttcaccgctaacggtgagcgggttcaattctttatccgtgctttctgcacagcgtacaaatccgttttctcgttatcgcaacgggataaatattggtgaaggtgcggcggtctttttaatgacgaaaacaaagttaaatgatgaaagcctacaattgttcggctatgggtcgagtagtgatgcttatcatatgtcttccccgcatcctgaaggcgagggagcaatttccgcttttgagaatgctttaaaaaacgccaatgttaaggctgaacaggttggttggattaatttgcatggtactggcacggttcaaaatgatcacatggaaagccttgcggttgaaaagatcttcggagataagaccacttgtaccacaactaaggtatatactggacatacgctgggtgcggcaggtgctattgaagcggcgattttgtggggtatgatcagtcgagattataatccaacgggtaaacttcccgcacaattgtgggatcaagaaaaagatgaaaatctgcccgcacttgcgattacagatcgggatagttattggaaaatggatagacgtattggtgtaagcagttcttttgcctttggcgggaataattcggttttggtgttgggggagtagcatggttaatttgcattgtccgattacgcaagtggctcccttgctgccgcatagtaacgatatggtgttgcttgatcttattacggattttggcgaagattttttgatcgctgaggcaaggattaaaagcgataatattcttattcgagaaggtaaactcagtgcattttccggtattgaaattatggctcaaggtgtggctgcttgggcaggatgtatggctgttcaagccaatgagccggtgcgtttagggtatttactcggcacgcgtaaattacatatttaccaagatgagattgcgatcggtagccgtcttcagattaaaataaacatgtccattcaagatgctgcggggtttggtgtatttgattgtcagcttattgatttagccgataatcatgtgattttggaaggggcattgaatgtgtttagtcctaaggaggaacaacaataatggcaaagacagttctgattaccggctcaagtcgcggtatcggcaaagcgattgctttaaaccttgccgcacaggggtatgatattgtggtgcattgtcgttctcgtgtagatgaggcggagaatgtggcacaagaggtgagagctttagggcaaaatgcaagagtactccaatttgatgtggctgatcgtgaaaaagtgcggtcaattttagaggcggatgtagaagaaaatggtgcgtattacggcatagtacttaatgcagggctaacccgtgataatgcttttccggcattgaccgatgatgattgggatagcgtgttacgcaccaatttagatggtttctataatgtgttgcacccgattatgatgccgatgatccgtcgtcgtcaagcggggcgaattgtgtgtattacgtctgtttcaggcttgattggtaaccgtggacaggtgaattacagtgcgtctaaagcgggtattatcggtgcggtcaaggcgttggctatcgaactggcaaaacgcaaaatcacggtaaattgtgtggctccggggttaattgacacggatattctggacgaaaatgtcccgatagctgagattttaaaaatgatccctgccggacgcatgggcgatcctgaagaagtcgctcatgccgtgcaatttttaatggatgaaaaagccgcttatattacccgtcaagtgattgcagtgaatggcgggctttgttaaagagcggtaaggatttcaatatttttattcacaattgaacattaacagcaaaaaggatacgaagtgaaacgggtggtagtcacaggaattggcggtatcactgcttttgggaatgattggcagaagataaaaacagcttttcaacgtaaacaaaatgccgtcaaatctatgaatgattgggttgaacgttttcccgaattggatgctcgtttaggtgcggttattgaggattactatcctccgaaacattggaaccgtaagcaattacgcagtttagggcgtgtttctcagctcgtagttgatgccagtgagcgagccttggctaacgcttctttattggacaaagacggtattattttggaatatttgaaagacggtagaatgggtgtggcttgcggttcttctaccggttctactaatgatattaaagatgcggcagaacttttgatgaccggtaagtcagacggtttcaacgccaacacttatgtacgtatgatgccccatactacggcggcaaatattggtattttctttggtttaacaggtaggattatccctacttccagtgcttgctcatcaggcagtcaagcgatcggctattcctatgaagccattaaatacggattgattcctatgatgcttgctggcggtggtgaagaattttgtccgtcagaggtttatgttttcgacagcctttatgcggcaagtcgtaataatgacaatccaagccatacgccacgtccatacgataaagcacgtgacggattagtgattggcgagggcggttgtatgtttgtgttggaagagcttgagcatgcattagctcgtggagcgaatattattgccgaagtggtcggttatggtgcaaatagtgacggtagtcatgttacccgcccgcaaaaagatacgatgcagcgttgtatggaattagccctgaaagatgcagggattgaaccgagtaaaattggttatgtcagtgggcatggtaccgctaccgaacaaggcgatattgcagaaacgcaagccactgaagcggtatttgggtatgttcccatgagttctcaaaaaagttatcttggtcatacgttgggagcttgcggtgcattggaatcttggttttccattgaaatgatgcgagatggctggtttgcaccaacgattaatcttgacaatgtagatgagcgttgtggtaaggtggattatattcaacatgatggacgagaaattcacacggattatgtcatgaacaataatttcgcattcggtggggtgaatacttctcttatttttaaacgctggacggatgaatagtggtaataagtcgctacatttcggggtgtacattatagaaattgctatggaattagctaaaattagcggcgttttgtaaagttgtggatagagaaaaagcgtatggcaaagatgataaatgatgggtgtaatatcgataatgactttgttcaaaagagtattaaacaatgacgcaacaaatctgtaatttttcatttaatcttcatgcgtggaatattgtctgtaataaagagctttccggagaggattggcaacaaggcgagcagtattggctggaaagtgttgctaaacgtgaaactgttgcacctaaactggcttttttaccgccgttaaaacgtcggcgtttaagtgaaagtgcacgtttattttttgaggcggcatggccgttaaccgaacaagagaataatttgccggtggtgtatgcttcgctgaatggagaaatcaatcgtagctttgccttgtggcattctctcttaactgaaggagatgtgtctcctacttcatttagtctttcggtgcataatgcccttgttggacaatggtctgaaatgcgtcaggttaaaaatgaaacgacggctattaccgccttaaaagatagcttggaaattgccttattagaggcttttctactcttaaatgatggacaagaaaaggtcttggtcgtgctttcggaaacaccgttatcagtgaaatacaatgctcaacccgtggagcgtttgcctttgtcttatgcgttggcgatggtggtggaaaaaggctcgacttatcagcttagtttgcaatcgcaagctgttgaaagtgcggtattttttgatagtgcactgacttgggtacaacagcaatatttggaggcatcccaatggcaaacccaaagtagtcgtggaggaacttggttatggaagaaaaacttgattggctaaggcgttttctcggtacgttatttggttttatattgttcggtttcgtcggcgtgctgtttaaaattatcctttatccttatgcaaagcaatatcccaaggcagatttagctacgcaattaaaaggacgtaaaattgtcagtcgtacttgggcattttttgtgcgttatcttatttgggcgggtattttagaggttcgttaccatggttttgagcgattggggcgtaaaggacagttagttttagctaatcacccctctttgcttgatgtggtgctgatttttagtcaagtgccggagtttaactgcattgtgaaacaagatttgttaaaaaatcctgctatgagcagcccgataaaagcctgtggttttgtgccgaatacagaatcggaagaattattggaaatgagccatcggattttacaagaacaatccttattactttttccggaagggactcgtacaggttgggatggtgtggtgaaattacatcgcggtgcggtttctattgggttgcgtagtgcaaaagtgatcacgccggtggtgattaaaatgaccccgttaaattttaaaaaaggacaaccttggtataaaattcctaaaactaagattgcgtatgaattaacagtgggcgaagatatcgatccgcaaaagtggtcggcggaaaagcccttgcctattgcctctcgccgtttaaatcaatacttggaagattattttaactcacaaacaaaggactaaataatggaacttgaattacaacttaaacaattaattattgacagccttgcacttgaggatattggtgttgaggatattgacactgatgcaccattatttggtgatgaggggttgggactggattcggtggatgcgttagagctgggattggcagtccaaaaaacgtttggtttacaattggatagcgaacaacaaaacttgcgtaatcattttgaaagtgtggcgactttagcaagttttattcaaagtcagaaacagtagaggaaaggaagtgaaatgacagaacaggaaattcaaaaggtgttgacggaagccttagtttcattatttgaaattgatgcggacaaaattaagcctgaaacaaatttataccaagatttagaaattgacagcattgatgcgattgatttaattgactatatcaaacgccaaaccggttataaattaaaggcggaagatttccgcaatgtgcgtaccgtaagtgatgttattgctgcggttcaaaaaatcagcgaaaacgcatagtcaagttgttgaggttgataaaacagcctttggggtcaagaccttgaggggggggatagtttggtgagtatagaacagcgacgcatgcaaagtgagcctgtgcagaatcctatttggttaagtgaaacacaagaggaaaatgtccaaattttccgagcgaaagtgccgccggatctgtgctatttcaaagggcattttgctaattttcctcttgtgccgggcgtggttgagttgcaatgggtgaaagagaaaatagatgcttactttggcaaagaaatgcagatgaatcgcattgataatttgaaattccaaaaatttcttcgcccaaacgatgaatttgagctcacattaaaatgggaagaaaacaaaaatcgaataggttttcagctcaaaactgagggcgaaatgtgtgccagtggtttcgtgattttcaaaaatggttaaattattcaatttattgattaacttggggttactgcttaccggcattggttatccgctggcgtggttttttgatgaaaaacaccaagggctttcgtatttagttgtaataatggcgttattatgggcagtcaaagcgataaaagcggtcagttttcatcggtttttggcaatcctaatggcgatattgcttggcatcgtttggcttactcgtagtctggaaacaatgtattggtatcctgtcatcatcagtacggcaatgcttattttatttggtggtagcttatttagctcacaatcgcttattgagcgtttcgctcgcctacaagattccaacctttctcctcaagccgttagttacacccgaaaagttaccctagtctggagtggattttttgtgctaaatattaccatttgcaccgcacttatcctcgctggacaatatcactggtgggcatggtactcaggcggagtttcctatgtactaatggggttattgatgtgcattgagcggttggttcgacaaaaggtaatcaaaaatggataagcaacataatcaagggtatgcggattttgctttgcgttgtcagcaaatacgccaacagcttgaggaagatcaggtaaaatcggtagggttatggttagataatgcagatcaatttgcctgcgtgttattggcttgtttgaatgcaaaagtcaatgtgttgttaccgccgaatttactcaatgaaaaccttgaatggttggaacaacattcagcattactctttgataaaaaaatggttgagcaatttgggtgttcgcaaaaaattcaaaaaattcaaccgctcttggataagcagagtgaaagcgaaatttggctaaaaacttcaggtagtagtgggcaagcgaaaattattcataaaactgctcgtcaaatgtgggctgaagctaaagccttagcctctgtcctaccatttaacgccaatgaacaaatttcagtcattggtagcgtcagtttgcaacatctttacggcttgactttccgtatatttttgcctttacaaatgggctggaaattaggtggtgagcagttacattaccctgaatatttactggcagaaagtcgtcattatcgcacgctttggattagtagccctgccttattgagccatctcaacttggcaagtttggaccagcatgtgcagattgcaggtatcatttcatccggcggggcgttacccgaacaaaccgcacttgctttgcgagaggaattgccttgccccgttattgaaatttacggtagtaccgaaaccggtgcgattgcttttcgtcagcaaaccggcgggctttggcaagcgatgccgaacactcggttgggattaaatgatgaagaggcgttgtgggttgaaaatgcatggattgtcggacgagagcaaacggcagatgcggtgcaatttagtgagcatgggtttgaattactgggaagaattgaccgcattatcaaattgggtgataagcgtttgtcattggtgaaaatagaacaagatttgctcaagcattgttttgtacaagattgctacattgcactacattgcctacatcagcgaccactagcttgggttgctttaaataaagaaggcattgcctattttaaacaacaaggacgtcaggcagttatttcacaatttcgccaacatttacgcctgacccaagaaaaatttgctttgcctcggtattggcgatttacggacaaattacctcgcaataaccaatcgaaaatcagccgtttagattttgaaaaaatttgtaccgcacttgagtatgaggtatttgcatgacagcgtttaatcccattgcgatcattccccattataaccattctgcaacggtaggtagcgtcgctgaacagcttaatcaattagggctacctgtattgatcgttgatgatggctcaagtcttgaacataaagcagtgattgagcaatttccacaaaatgaacagctttccattttattttgtgaaatcaacggtggtaaaggtgctgcttttaaagcaggcttaaaacagacacaaaaacttggatttagccacgctattcaagtagatgcagatgggcagcataatataattgatgtcaagaaaatgctcgaacaagcggaaaaatcgccgaatgcaatagtatgtggtaaaccgatttatggcaaagatgctccaaaatctcgcttatatgggcgaaaaattaccgatttttggaatgcaatcaatacgttatcctttgatattaaagacgggatgtgtggttttcgaatttatcctattactcaaattatgcccattcttgcacaagagcaaattggtggtggtatggattttgacacagaaattttaatccatagttattggcagaaaattccgcttatttgggttgataccccagtaaaatatgaaaaagatggcatctctcattttcgtggttgggcggataactggctgctcagcaaaatgcacgcacgccttttcttccgtatgctcaaacgactctttacaggaaaaattcgatgaataaacattgggcaaaacaacaagagcgtggtactgccttttttctaaccttaactcgtttaattgtgaagtatttgccattgcccataattcgagcagtgaatttttgggtggtgttatatttttatctcacttctcggcaaaaacggtgctacattgcagaatatcagcaaaaactgaccgctctttttcctgaaactaagttacctaaatatgcggtatttagacaatttctcgcttttggcgaagccattactgatcgtttcgccgtatggcaaaaaaaaattcgttatgaacatcttatcgttgatgatgcggataatctttatgcagatatcagcggcaatggtcgaggacaaattttggtttgctctcattttggcaatattgagatctgtcgggctttgttcggtagcggacagcacgaaaattttaaactgaatgtactggtacataatcgacatgctgcagcatttaataaaacattgggtgatgcaggtgctgatgaattaccgctgattcaagtggaagacctcaatgtacaaaaaatgctggaacttgctgaaaaaattgatcgtggcgaatggattgcgattgccgccgaccgcattcccgtacgtggcgataaaacggagccggtcaattttttgggttctccagccgagtttcctcaaggtgcttggctgctggcaagtttattgaaagtgccgcttaataccatcttttgcatcaaagaacaggggcgttaccgtttgcagcttcgccgttttagtgaaagtattcaaggtcgaggaaaagtgcgtgaacagaatataagaaatgtcatgcaaaaatatgcggatttactggcaaaagaatgtgcaaaatcaccatttttgtggtttaatttctatgatttttggcatcgcaaagattaacttacttttctcaaggagattttatgaaactgatcaaaatattagctttaactttttctgcggttgtgattgttgcttgtgcacctcgtgatacaacccattatttatctattcaggaagccttaagttctcctgaggctaaaaaaatactgaatcctaaaatcaagctttattttggtaaacctgcaccgggtcaagtgattcaaaaaggggcggttaccaacccgaaaacgaatgcggtgaataaaacagataaagaagcgtgccaatgggtattcttatctgcagtgaaacgtttccaagatcaagcggtagctaaaggggtaactaaagtgggtaacctcgtgagttattacaagaaaaaagaatatagtagtaccactaaatatgagtgccatgccggtagaagtattgctggtgtagcattaaaaggcgattttgttaagtaaagctattaataatctaggataaacaagcggtttaatttcttgaaaaaatgagcaaaattaaaccgctcttttgcttaaaatgagacttaaaaaacacatttacgctgaacatttttccgactatgaaatcccattttttgatgtggactccatgtttattatgtggcatggtcattatgtcaaatatttagaaatggctcgctgtgcatttttagaagaaattcactatacctacgatgtgatgcgagaaaaaggttacggctggccaattgttcaacttcatttgaaatatgttaaacctgccgtatttcgccaaaaaattcgggtgcatttagctgttgtagaatacgaaagctgtatccgtattgattacaccattactgatttagccaccaaacaaaaactgacaaagggtagtaccacccaagttgccgttgatatttcaaccggtgaaatgcaattacaaacgccacaatcttggcgtgatgcgatagaaagctatcatgggtttattgctgagtgagagagcgttaatgaaaaaatatctttttgtcttgttaatattattatgttgcaaaaatctttgggctttttctcaggatgatttagtacatttgttacaaaagccacagaatacgcaaggtgaatttagtcaacaacgttatttaaaagccttaaccaaacccattatcacttcaggaaaatttattttaataaaaaataaagggttggtttgggaaacggaaaaaccgtttacacatcaattgaaagtgacggcaaaaggcattagccaatggaatggaacagcatgggaaaaccattctcgtttaggtcagggtgagcaaattaaactattcttaggcttattgtccggcgatattcaagcacttgcgacacaatttgacgtagtgctttcaggagatgaaaaaaattggcaacttcagctcatgcccagcagtttgctgatgaaacaaatttttaatcaaattattattcagggcaatgtagctgtgcaacgtattgaattgcatgaaaaacagggagatcgtaccttgattttgtttaataatcagcagattaaccttccattatcaccctttattcaatctgccttccaataggaatttgcatgcgcaaattattgaccgtttaccgcttaatttttgccggggttttatgtcttgtggtggcgatttttatgtatcatttacaaacaggtaaatggttacaaacggatctacatacacttttgccggacagtcaacactatacaaaaattcaattagaggcagataaacatcaagaacagcaatttaatcagcaagttattgcattggttggacattcacaatcagaagctgcttttaaattgacggaaaaagttgcagaacaatggcaaaaaagtgggttatttcaaacgttatctgtaaaaaatcaaccgaatttagctgaacttcaacagcagattgagttattaaaattagccacactgcctatttcaacacgaaatcagattattcaacagcccgaacgttattttcagcaatatgcagagcaaatcattaacccgttcggttatcaaaatttgctccccttggaacaagactggcttggttttgggcgttttgtattgtcgcaatctcagcagcaaagtcaaattcagtggcatgcagaaacaggtatgctctatgctgttcaacaaggtaagacatgggttttattaacaggcaaaattgttgattcagatttgatcaaacctcagcaaaatttaaccgcacttcttaagcaaaatgcacaatttattcaagaacaacaaggtcaatggttaagtacaggtgcggtgatttttgcggattattcacaacaacaagctaaatatgaaagcacgatcatgggcgggttaggtatcagcctaaccttgcttttactgttgctggttttccgtagcttacgcatattatggttatttttaccgatttctgtaggtatggttgcaggtattactgctactattagttgctttgggcagattcatattttaacgctcgtgattggcacgagtttagtgggggttctgattgatttcccattgcattggcttacatcttctctatttttaagccgatggcgtgccaataaagcgatggcaaaacttcgccttactttttttgtcagcttattggtgactttgctgggttatgctttactgggatttactgctttacctatcctaaaacagaccgcacttttttccggtatggcgttgatttttgctgtcttaacgaccttcttgtatttgcccctatttttccgacattaccagtcagataagtctttgtttttacgaagaattttgaaaataaatttccacgttaagattaattcattattaaataagattttatttgtggttagcacgggtttcattgtagtagggttgcagaaaagctattggcaagatgatattcgtcaatgggttgctatgccaacggaattgattgagcaggcacaaaaaattcgtcaaattaccggcattgatctaagcaaccaatacttattaattactgctgaaaataatgagcaattattgcaaaaagaccaaattctaaccgagaaattacaacggttcgcacaagaaaataatctgataaaatttcagtcattaagccaatggattatgtcaaaaaagcaacaagcggagtttattcaacagctaaaaaatattcctgctgaaagctatagcgtttttgatgaaattggtattccaaaggacatgattcgtcattcgctaaaaaaattggaaaaacagcctcttgtcagcttagaacaagctttaaatacagaattgggaaaagtttggaaaaatctatatttaggtgagcttgatcgaggaaaagtagcaagtattattaaagtatcaggattgaataacccaaaaattcttgagcaaattgttaataatcgggatatttactggcaggataaacctgcccatctcaatcagttgtttgagcaaacccgcaaccaagcggcttggttaaaattgctctcatttggcttggcagctttattgttgtggcgaatgtttggcatatcgcaaacgttgaaaatgctcagtatcccgcttatttcagttgtgtgtacagtcgcaattttaggttggttaaatatcaccatcagtttgtttgctatgtttgggttattattggtgtcggtcattggtattgattacattgcctatatgcaaacagcgaaagagccgttatcaataaaacgttttacgattagccttgcagcacttaccacgcttatttcatttgctttattaggattaagctccactccggcggtagcaagttttggcttgagtgtcagtttgggggtgctgattagcttaggaatgattttgcgaataaagtgaagtaatggtgaatatattttcacatcctatcttatggctgattaattgcgatagatatatcatttttatggcaaaacaggattgcataagcactaaaactcaaaaagggctgatgtcagccccttgttgttagcatcaaattaaaataatactctcgcacgaatagtgccttcaatttgcttaagtttagccaataattgagcggtatcttctgtttcaacatcgattaccacataaccaatttttgcctcggtttgtaaatattcagccgcaatattgatattttgctccacaaatatttgattgattttatttaaaatccccggacggttatggtgaatatgtaataagcgttttgcattactatgttccggtagagatacttctgggaaatttactgccgacagtgttgaaccattatcggaatatttgacaaatttatttgcgacttcaactccaatattttcttgtgcttcaacagttgagccaccaatgtgtggtgttaggataacattatcgaaagcacgcaatggcgagataaattcctcttcaatcgaggcaggttctttcgggaatacatcaattgcggcaccacgaatttttttgctttctaacgcctgagttaaagcgtcaatatcaaccactgtgccacgggcagcgttgataaaaatacagttcgcctttaattgtgcaatgcgttccgcattcattaaattttttgttgaggaattttccggcaaatgtaatgaaaccacatcacaggtactcaaaagttcttctaagctattcatttgttgtgcattacctaaaggtaattttgtttctatatcatagaaatacacattcatgcctaacgcttctgcaataatacttagttgagatccaatatgaccataaccaataatacccaagcgttttccacgaacctcataagatcccaccatggatttattccataaacctcgatgcacatcggcattggcttgcggtatattacgcattaataataagatctcaccaagcactaattcagccacagatctggtattggcaaacggtgcattgaaaacaggaatacctcgtgcttttgccgcttctaaatccacttgatttgtgccgatacaaaaacaaccaattgcaattaattttgttgcttctgctaatatatcctccgttaaagacgttcgagaacgaataccgataaaatgtgcatctttgatagcaatttttaattcatcaggttctaaggccttccgatgatattcgatattggtatatcctgctgcttttaacacctccagtgcattttggtgtattccctccaaaagcaaaaacttaatttttgatttatctagtgatacttttgttgtcatattgcctctccatatatttaaataattatccaataatttttgtaccctccggcgtacctacaataacaatatctgcagaacgtaaagcaaaaatcccatttgttaccacgccggccacattattcaattctttttccatttctatcggattcataattttaaagttatatacatctaaaataacattaccattatctgtaaccacattttcacgatattcaggtgaaccgcccaacgccactaatttgcgtgcaacttgagagcgagccattggaatcacctctatcggcaaagcgaacgttgagcctaatacatccacttgtttagaactgtctactatacatatgaatttttttgccaatgcggctacaattttttcacgtgtcaatgctgctccgccacctttaatcatcattttttgcggattaatttcatctgcaccatcgacataaatatctaaaccggatacatcatttgcactgaatacctcgataccttgtcggagtaataattcttctgatgcttttgaagctgcgacagcacctttgattgtttcttttattgtacctaatacttcaataaaacaattgacagttgaaccgcttcctacgccaataatactatcaggtttaacatattgcagtgcagcttgagcagccatttttttcatgcttaactgatccattttttatcctttttctatgattttatgtttatgtcgtacaaagcaaatatttttataagttcactactttaaaactattcacttaaatacacaagctaatcaggcaaaaactccgttaataattcattaaggaaaagttttccttgttcagtgatttgccaagtgcggttcgtttctgataaatagtttttctctaacgcccaatcaatttgtttttgtaccgcactttgtgctaatccagttaacagttcaaattgttgtttttccataggttccaataaacgaaagcgattcataaaaaactcaaatggacgttctgaaaaagggatatttttttcctcatatagatattcaccacgcatatagcctttagggtgtttcgttttagaaaaacgtaaaatttgtccatcagcaaaactcaatttaccatgtgctccacacccaatagctaaataatcaccaaatctccaataattcaaattgtgttgacattgaaaatcaacttttgcataagcagaggtttcatattgttggtaacctgctttggataacaattgatgaccctgctcaaaaatatcccaaagttcatcttcatcgggtaatttcggcggacgatatgcaaacattgtattaggctcaattgtgagttgataccaagataaatgaggcggttttaaagcaatagcttgctgtaaatcgtccagtgcttgcaccaaagattgattgggtaatccgtgcattaaatccaagttaaaactgtttaatccggaatgttgagcaaaacgcaccgcactttttgcttcaactgcattatgggcacgccccagtctctgtaatttttcattattaaaactttgaatccctatagaaattcgattcactccggcttgtgcatatccgacaaaccgatcgctttcagctgttacaggatttgactcaagcgtaatttcaatattatcctcaaaaggaataagttgtttaatttgattcaataaataatcaatactttgtacagaaaataggctaggagttccgcctccaatgaaaatagaatgcaattttcggtcggctattgaggcatgataacgtaccaaatcttgctttaagtcagtaagcaaatgggtaacatattcagtttccggaataagccctttttgtgcatgggagttgaaatcacaataagggcatttttgtacacaccaagggatatgtatatataaacttaatggaggtagctgaatgggaaatagtttaacaagggagaattgtgtcattatttcaaccgctcttttaatactgcgagagctttggctcgatgtgaaattttctttttctccgatgtttccagttcagcaaaagtacaacctgtttcaggatagaaaaataagctgtcataagcaaagccatttgaaccgctttcagaaaaagcaattattccatgacattcaccttcagcaataattggcgatggatcagtgtcatgttgcagcatgacaatacaactcacaaatttggcatgacgctcattaacgggcacattagccagttccgctaataacttttctctatttttctgctccgcatctttgtcctcaactccggcatagcgagcggaatataatcctggtgcaccgtttagtacaggaacaaccaatccactgtcatcagcaatcgcaggtaagcctgacatttttgctgcataacgtgcttttagaagtgcattttctacaaaagtcaaacccgtttcttccggactgtcaatacctaaatctttttgtgcaacaacatcaaaaccaaattcagataatacatctgccatttcttttactttcccaggattagctgttgctagtacaattttttgtttcattaccgttcctttttcaatgaataaccagtttgctattttaagcacttcgcaggtattttttaagatgctgttttaagataagtcccctgaatgataaaatatttttgcttcctacagaaatatcccctcaacattgttaaaaattgaggggatattgatttatattgtcaaaagttatttggcatgtgtctagaaaatgatgcgatctctatttttttctagtgttgctttgccaatccccttgacttcaagtaactgttcagccgcggtaaatttaccaaatttttcacgatattgaacaattgcctcggcttttttgcttccaattcctattaaagcgtgtttaatttcttccgctgttgcagtattgatgttcaatttatcgctaataatgaccggttcaacttgttgtgttgcttgggctgaactaggtggttgagttggtgtttctgcaaatgcattaaaagcacccaaagcaacacttaacatcaataatgatttgaaaaatgaggttatttttttcattttgtcttccttacagtaaatgataaccaaagtttaaaaaattgaactgttgaattgattcaacaacagacattttgcatggaggcgaaaaacttacgagaaaatcactgcacttttacgatcaagatcgcaaaaataacaaaatggattagcaaaaagagacttttttgtgaaaaaacgagtattcactaaaagcgaatccccgtttttttgaagagaaattattgacgtactgcgatagcttcaatttcaataccgacatcttttggtaagcgagctacttcaacacaagaacgtgctgggaaagttgggtgattattttccacaaagaaacgctcatattctgcatttacggttgcaaattgatttaagtctttaacaaaaacagttgttttaacaatatctgctacggtcaatcctgcctgtgcaagaattgctttaatattttccaaagattggcgagcttgtgtcgtaatatccgccggaatttccccagttgcaggattaaccggaatttgaccagaagttaaaactaaattacctaaatccacagcttggacataggggccaattgctgccggtgctttttctgtgtgaataatttttgtcattttttctccttaattcaacgatattttcacgctaactattgtacgcttttaaaaataaacttaaagcccattcatggcgtttatcaagcgaatttcttcatattgtgccagatcctcgaaaaaaatttctcttgcaataattttcttttgctcaagtaattttgctcgttgtgtaccttctaataacggtttattgggagttatccattgattattttggcgaaaaatcaagtttccaatagagcaatccgttactttgccttgacgaataatcataatttcatcacattcttctttttgttttaagaggttgtttaacaatgttcgatctgaaaatttcaaactgtaatcaatatgatcacagaaaacaggtttaaaagttcgataaactttttgttggtaaggaaagcattgaagaacgtaatcatgatggttgtaatcaatacggcaacgtattaagccttctcggtgggtgaaaagtgcggtatgtttagcaataatttttgctaaatcaaatggttgtaatttcattttgggataaaacttcagcaggcttttttcataacgttgctgatgataggaaatatttttagcttgaccttgttcaattaagatcgtttcaaataaaggaaattgccacattttctgttaataattatcaaatagtcatatctgcatcaaaaattatttctctacttaaatcttgagataaagaaataaaagctagctacttagttttcctcactattggataaaccgctgtttaggctctaaatagtccttaattcgcttattttatgaggggtaaatatactttagcacacagctcgttgtattcatcttctatatcactttgaattgtaatgccacctccgctacgaaaataatagccatcgctccgtttctcaataaagcgaatagcgaccgcactttgtaaggtttctccatcaaaaataccaaaaacaccggtgtagtaacctctcttttgctgctccgcttgttgaataatttccaccgttttttcttttggtgcaccgctaatagaacccgccggtaatagtgcggctaaaatatgtccaatattatgtcgccaattttcctctaactcaccacaaatttcggaacttgtttgcaaaattgcacctcgttcagtatgaattttttcaacatagcgaaaacgtttaacttcaatatttttagctacaatagctaaatcattacgcattaaatccacaatggtatagtgttcacgcaactctttttgtgaatttagtaattgttgctcagcattttctaacgttgcatttatcgtgcccttcattggataggtgtaaattttattttcataaatttgaataaacggctcaggcgaaaaacaaataaattcatttttaaacaataacttataacttgcttttgtttgttgaaataactgtattaaactataatttgtttcaattttgctcggataagtaagatttaacaaataagagttacctttttgtaactcgctcttaaccagctcaaatccctgctgataatctttaaatttcataggattaaatgaaaaatgacaatcttttgtggaaaattcaaaatgccaatctacattactttttattccttgcggttgtaaaatagtaaaaaagatattttcttttgctgcttgttcaatgggtaaaataattggtttttgctgttcaaaatcaatcaaaaagaaaaaaggtaatttattttgcccaaaataattcgcttgttgggcaaaatcacgaaattgacttgagttattcaatgacatagtgatgaaaaatttagtaatatacgcaatctgccgattttagcttaagatgaaacatgaacacaaatttattagtcattaataatcatgactcttttacttataacttagtggatctcattcgccgtttaggtacgccttttaaagttgtgaatgtagaggatttatctttggtggaaatagaaaatttttctcacctgttaatttctccgggacctgatgttcctcatgcatatccccaactttttgatttactggaaaaatactatcaatacaaatctattttgggtgtttgcttaggacatcaaactttatgtgaatttttcggcggaaaattgtataatttgcagaatgtacgtcatggacaagctaaacagctaaaagtgcggtctaattcgagactatttagaaatttacccttaacatttcaaattggactttatcattcttgggcagtaagtcctgaaaactttccggaagatcttgaaattactgcgatttgtgatgatgaagtaatcatggcgatgcaacataaaaccttgcccatttacggcgtacaatttcatcccgagtcttatatttcggagtttggtaagcaaatcatacaaaattggctaagtaattgataattataataaattcataataactattaaaaataaaaaaatgatagaaatttcctatgaattttatcaataatatccattttgttagtaaggaattattatttatcatataatcagtaaagacatcaataaacataaataggagaaagcttatgacaacaactatcggcttagatcgcaatagttcaaaacaattagcaacagaattaaataatttattagcaagttatcaaatattctacatgaatgtacgtggctatcattggaatattaaaggtgtaaatttctttgaattacacgcaaaatttgaagagatttatgatgatttagtggtgaaagtagatgaaattgcagaacgtattttaactttaggttataccccaagcaatgcgtttagtgaatatttgacacaatcgcaaattcaggagcatattaatgtaactaacgcacaggactgtttaaacggtaccctacaagggtttaaaacattgttaaaacaacaacgtagtatccttgctattgcatcagatgccaatgatgaaggtaccgcttcgcaaatgagtgattatattaaagagcatgagaaattaatttggatgttcagtgcggcttgtgaaagttgtcatgcttaatttgtgtaatatcacatcattttaaatctaaaagttaaaataaaacctctagctgtgcctagaggttttttcgtttatatgaaaagctaaatattgtgtttatttgccgatacagaaagagctaaaaatattgcctaataaatcatcggaagtaaattgtcctgtaatttcacttagatgatgttgcactatacgcagttcttcagcgactaattcacctgcataaaattctgtcaactgaatcaatccggcttgtaaatgaatgtcagcttgttctaaggcctctaaatgacgacgacgggctaaaaatcccccctcagtgcagacttgatagcccatggactgttttaaatgctgacgcaacaaatcaacacctttttgtgtttttgccgacaatgaaataacagttaaaccgttttgttcatttaaaacttctgcttcaccacttaaatcagctttgtttcttactatggttaaaggaatatgtggcggtaattttgccataaattcagaccgcactaaatccagttcaacttgattttccgtgctatccaagattaacaaaatacgatcagcctgttcaatttcatcccaagcacgacgaataccaattttttcgacctcatcggttgcatcacgtaaccctgccgtatcaataatatgtaaaggcattccgtcaatatgaatatgctcacgcaaaacatctcgagttgttccagcaatatccgtaacaattgccgcctcacgccctgctagtgtgtttaataaactggattttccggcatttgggcgaccggcaatgactactttcattccttcacgtaaaatagccccttgttttgcctcattttttactttagctaacttggctatgatttcacgtaaatgcgtttcaattttaccgtctgcaagaaagtcaatttcttcgtcagggaaatcaattgctgcttcaacataagtgcgtaaataaataactgagtcaactaattcattgattttatttgaaaactcaccttgcaatgattttaacgcagaacgtgctgcttgctccgaactcgcctcaattaaatcagcaattgcttctgcttgagctaaatctaatttatcattaagaaacgcctgttcagaaaattcccccggtcgtgccaaacgaataccgtcaatttgtaaaatacgttttaataaaagatccatgacgatttgtccgccatgtccttgtaactcaagaacattttctccggtaaaagaattgggtgctttaaaataaagtgctatcccttgatccaatacactaccatcagaatctttaaaaggaagataatttgccatcctaggtgttaaggttttaccgagtacttgttcagcaacctgctgagctaaaggtcctgatacacgtaaaatcccaactccaccacgtccaataggcgttgcttgagctacaatagtatctctactcataatttgtttccaaaagtgcggtcaaaaatcgtatagaattataacaaaaaaggcatcatctaagatgcctttcttttatttaggattatttttttactctggtatgtaagccttttttctccaaaccacgataaattaaccattgttgtgcaatagtaataaggttagaggctaaccaatataacactaagcctgcggggaagaataagaagaacaccatgaaaattaatggcataaacgtcatcactttttgttgcatcggatcggcaacaggtgttggtgacattttttgcaataggaacattgaggcacccattaggatcggtaagataaaatacggatcctgtgcggataaatcttgtacccaaccaaagaatggggcatgacgtaattcaacggcttccataaatgtccaatacaaagcaatgaaaattggcatttgtagaagaattggtaagcaaccgccaagaggattgactttctcttctttgtaaagtttcatcatttcttggctcatacgttggcgatcttcaccaaaacgctcacgcatttcttgcaatttaggttgtaacatacgcatttttgccatcgacgtatattgtgctttggttaacgggtatagaactgcttttactactaaagtgacaccaataattgccagaccccagttttgtacaagagattggattagggttagcaatttaaatagaggtttcgcaataaaccaagcccaaccataatcaacggttaaatccaaatgattagccacatcagccatttgatcttgtaatttcggaccagtccataattgagtatgaatagtttcagttgcaccgttttctattacaatcggagcagatcgataaccaatagaacccaagtgtttcttagtatttgtcagcgtgtacaaggtattattagcatcttgattaggaatccaagcggagacgaaataatgttgcaacaaggcaacccaaccggctttggtatgaatatctaaatctgctttttccatgtcttcaaaactatattttttatagttggtttctgacgatgaataagcaccgccggtataagtcggcattgccatgctacctgaactttcaactagcgtatgagttaattgtgcataaggaactagttcaatcggttttgggctttggttggtaatttcaaaattgacctctaatgcgtaagacccaggttttaatacaaagactttacgatagatcacaccatctttctcaaagatcaaaggcacttttaattcctgctgaccttctgctaacttaaacacatcaccttcaacttggtaatttgcacgaccagcacgactatcaatgccattttttccgactaagccgctttgtgcaatatatactttatccgcattgttctgtaataagacgaaaggtgctgaagaatgtaattctgcatcatagttcaataattcagaaccgatcacgtccccccccaaagtatttacctttaaacggaaaacatcattttctaaggtaataacacgacctttagcctgtgtatcattagcaatatctgacgttgctgtaagtgcggttgagttcacttcagaaacctgagcttgttcagtcacttccggcttaggcgtgttatagtctacttgccattgctgataaataaggaaggaaatgaaaagaagtgccataaataataggctgcgtttagaatccattattcgttctctttgttgttattaatctttgggggaacaggatcgtatccgcccacattaaaaggatgacattttaatatacgtttaactgtaagccaactaccttttactacaccatgcgtttttactgcttgaataccataacaagaacaagttggcacaaaacgacagcgaggaccaatcagcgggctaatcatcaattgataaatcctaattgcaccaattaagacttttgcaccaaacgaatgtgacgtttccatagcttatccaaagtttgaaataattgctggttatctaaattaccaatacctttctttgttattattacaaaatcataattagccagctgtccttgtaataaacggaaactttcacgagaaatgcgtttaacacgattgcgatcatgtgcacgttttaaatgcttcttcgcaacagtcaagcctaaccgagaatgttccaaattattttttcgagcaagaatggtaatttcaggggtgctaacacgcaatggtttttgaaaaacgcatttgaaatgagagggagtcagcaatcgtaactccctggaaaagcctagcttaaccacagcaaagggctggattatgcagataaactcttacgacctttagcacgacgacgagctaaaacttgacggccgtttttagtcgccatacgagcacgaaaaccgtgtgtacggttacgttttaatacagaaggttggaatgtacgtttcattataatctacctaaatctaaataaaaaatttgttataccattgcccttgtaaaat
